United States Patent 11,141,474 (ARTIFICIAL NUCLEIC ACID MOLECULES ENCODING A NOROVIRUS ANTIGEN AND USES THEREOF) - sequence listing, part 3

SEQ ID NO: 6073 - RNA, 1623 nt, Artificial Sequence
  capsid_protein__Norovirus__ACJ66275
augaagauggcgucgagugacgccagcccaucugauggguccgcagccaaccucgucccagaggucaacaaugagguuauggcucuggagcccguuguuggugccgcuauugcggcaccuguagcgggccaacaaaacauaauugaccccuggauuagaaauaauuuuguacaagccccugguggagaauucacagugucccccagaaaugcuccaggugaaauacuauggagcgcaccuuuaggcccugauuugaaccccuaccuuucccauuugucuagaauguauaaugguuaugcaggugguuuugaagugcaagugauccucgcggggaaugcguucaccgccgggaaggucauauuugcagcagucccuccaaauuuuccaacugaaggucuaagcccuagucaaguuacuauguucccccauauaauuguagauguuagacaauuggagccuguguugaucccucuacccgauguuaggaauaauuuuuaccauuacaaucagacaaaugacccuaccauuaaauugauagcaauguuguauacaccacucagagcuaauaaugcuggggacgacgucuucacagucucuugucgaguccucacgagaccauccccugauuuugauuucauauucuuagugccaccaacaguugaaucaagaacuaaaccguuuacugucccaaucuuaacuguugaggaaaugaccaacucuagauuccccauuccuuuggaaagguuguacacgggucccagcagugcuuuuguuguccagccacaaaauggcaggugcacgacugauggcgugcucuuaggcaccacccagcugucugcugucaacaucugcaccuucaggggggaugucacccacauugcaggcucccguaauuauacaaugaauuuggccucucaaaauuggaacaauuaugacccaacagaagaaaucccagccccucuggggaccccagauuuuguagggaagauccaaggcaugcucacccaaaccacaagaggagauggcucgacucguggccacaaagccacaguguacacugggagugccgacuuugccccaaaacugggcagaguucaauuugcuacugacacagacaacgauuuugaauccaaucaaaacacaaaauucaccccagucggugucauccaggaugguaacaccacccaucgaaaugaaccccaacaauggguacucccagguuacucagguagagauggucacaauguacaccuagccccugccgucgcccccaccuacccgggugagcaacuccuuuucuuuagguccaccaugcccggauguagcggguaucccaacauggaucuagauugcuuacucccccaggaaugggugcagcacuucuaccaagaagcagcuccagcacaaucugaaguggcucugcuaagauuugugaauccagauacagguaggguuuuguuugagugcaagcuccauaaaucaggguaugucacaguggcucauacuggucagcaugauuugguuauuccccccaaugguuauuuuagauuugauuccuggguuaaccaguuuuacacacuugcccccaugggaaauggagcggggcguaggcgugcauuauaa

SEQ ID NO: 6074 - RNA, 1623 nt, Artificial Sequence
  capsid_protein__Norovirus__ACJ66279
augaagauggcgucgaaugacgcuaccccaucugauggguccacagccaaccucgucccagaggucaacaaugagguuauggcuuuggagcccguugugggugccgcuauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucauuacaaucaaucaaaugaccccacuaucaaauugauagcaaugcuguauacaccacuuagggcuaacaaugcuggggacgaugucuucacagucucuugucgaguucucacgagaccaucccccgauuuugauuucauauuucuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccguggucacaaagccacagugagcacuggaaguguccacuuuaccccaaaguugggcaguguucaauucuccacugauacaagcaaugacuuugaaacuggccaaaacacgagauucaccccagucggugucguccaggaugguaguaccacccaccaaaaugaaccccaacaaugggugcucccagauuauucagguagagauagucacaauguacaccuagccccugccguggcccccaauuucccgggugagcaacuucuuuucuuuagguccacuaugcccggaugcagcggguaucccaacaugaauuuggauugccuacucccccaggagugggugcaacacuucuaccaagagucagccccagcacaaucugauguggcacugcugagauuugugaauccagacacagguaggguuuuguuugagugcaagcuucauaaaucaggcuacguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6075 - RNA, 1623 nt, Artificial Sequence
  capsid_protein__Norovirus__ACJ66281
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuguggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaaaaaaugaccaauucaagauuccccauuccuuuggaaaaguuguucacgggucccagcggugccuuuguuguccagccacaaaauggcaggugcacgacugauggcgugcucuuaggcaccacccaacugucuccugucaacaucugcaccuucagaggggaugucacccacaucgcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuaccccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcauuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6076 - RNA, 1623 nt, Artificial Sequence
  capsid_protein__Norovirus__ACJ66283
augaagauggcgucgaaugacgccaacccaucugauggguccgcagccaaccucguccuagaggucaacaaugagguuauggcuuuggagcccguugucggugccgcuaucgcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucaccauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucggauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6077 - RNA, 1623 nt, Artificial Sequence
  capsid_protein__Norovirus__ACJ66285
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugacccccggauuagaaauaauuuuguacaagccccugguggagaguuuacaguauccccuagaaacgcuccaggugaaauacuauggagcgcgcccuugggcccugaucugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaagguuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuuguuggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacaaggagugauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuacucagguagagauagucacaaugugcaccuagccccugccguggcccccucuuuuccgggugagcaacuucuuuucuucagguccacuaugcccggaugcaguggguaucccaacaugaauuuggauugccuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuauacacuugcccccaugggaaauggaacggggcguagacgugcauuauaa

SEQ ID NO: 6078 - RNA, 1623 nt, Artificial Sequence
  capsid_protein__Norovirus__ACJ66286
augaagauggcgucgaaugacgccaacccaucugauggguccgcagccaaccucgucccagaggucaacaaugagguuauggcuuuggagcccguugucggugccgcuaucgcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucaccauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucggauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6079 - RNA, 1626 nt, Artificial Sequence
  capsid_protein__Norovirus__ACJ72216
augaggaugagugauggcgcagcgccaaaagccaacggcucugaagccagcggccaggaucuuguuccuaccgccguugaacaggccguccccauucagcccguggcuggcgcggcucuugccgcccccgccgccgggcagauuaaccaaauugaccccuggaucuuccaaaauuuuguccaaugcccccuuggugaguuuuccauuucaccucgaaacaccccaggugaaauauuguuugauuuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuccccaagggcucacucaccacugcucagaucacaugcuucccacacgucaugugugaugugcgcaccuuggagcccauucaacugccucuucuugacgugcgccgaguucuuuggcaugcuacccaggaucaggaggaaucuaugcgccugguuugcaugcuguacacgccacuccgcacaaacagcccgggugaugagucuuuuguggucucuggccgccuucuuucuaagccggcagcugauuucaacuuugucuaucugaccccccccaucgagagaaccaucuaucggauggucgacuugcccguguugcagccgcggcugugcacgcacgcucguuggccggcuccaaucuauggccucuugguggacccaucccucccauccaacccccaauggcagaauggaagaguccauguugauggaacccuccuuggcacaacgcccaucucuggcuccugggucuccugcuucgcagcugaggccgccuacgaguuccagucugggacuggugaggugguaaccuucagcaugauugagcaggacggauccgccuaugucccuggugacagggcggcuccccuuggauaucccgacuacucagggcagcuggagauugaggugcagacugagaccaccaaggccggggauaagcuuaaagucaccaccuuugagaugauucucggucccaccaccaacguggaccaggcucccuaccagggcaaagccuaugcgagccuaucaaccacggccucgcuugaccugguggauggaagaguaagggcggucccccgcucugucuacucuuuucaggaugugcucccagaguauaaugauggucuuuugguuccccuugcccccccccuaggcccuuaccuuccuggugaggucuuguugagguuucggaccuacaugcgucagcuugacaccgcugacgccgccgcucagccgauugacugugccuugccucaagaguucaucucuugguucgcaagcagcaacuucacgguucagucagaagcgcuccugguuagguaccgaaacaccuugaccggccagcucuuguuugaggcaaagcucuacagcgaaggcuacauugcugugucuuauucagggucugguccccucaccuuucccacugacggcuucuuugaggucguuaguugggucccccgccucuuucaauuggccucugugggaagcuuggcaacaggccgaacacucaaacaguaa

SEQ ID NO: 6080 - RNA, 1620 nt, Artificial Sequence
  capsid_protein__Norovirus__ACL27297
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauucccuuaccugauguuaggaacaauuucuaucauuacaaucaaucaaaugauuccaccauuaaauugauagcaaugcuguauacaccacuuagggcuaauaaugcuggggcagacgucuucacagucucucgucgaguccucacgaggccaucccccgauuuugauuucauauucucggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcaccacccagcugucugccgucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugaguacugggaguguccacuuuacuccaaagcugggcaguguucaguacaccacugacacaaacaaugauuuucaaacuggccaaaacacgaaauucaccccagucggcgucauccaggacgguaauaaccaucaaaaugaaccccaacaauggguacucccaaauuacucaggcagaacuggucauaaugugcaccuagcuccugccguugcucccacuuuuccgggugagcaacuucuuuucuuuagguccacuaugcccggauguagcggguaucccaacaugaaccuggauugccuacucccccaggaaugggugcagcacuucuaccaagaagcagcuccagcacaaucugauguagcucugcugagauuugugaauccagauacagguaggguucuguuugagugcaagcuccauaaaucaggcuauguuacaguggcucacacuggcccgcaugauuugguuaucccccccaaugguuacuucagauuugauuccugggucaaccaguucuacacacuugcccccaugggaaauggagcggggcguagacgugcauuauaa

SEQ ID NO: 6081 - RNA, 1623 nt, Artificial Sequence
  capsid_protein__Norovirus__ACL27298
augaagauggcgucgaaugacgccagcccaucugauggguccacagccaaccucgucccagaggucaacaaugagguuauggcuuuggagcccguuguuggugccgcaauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuuucucauuuggccagaauguacaaugguuaugcaggugguuuugaagugcagguaauucucgcggggaacgcguucaccgccgggaagaucauauuugcagcagucccaccaaauuucccaacugaaggcuugagccccagccaggucacuauguucccccauauaauaguagauguuaggcaacuggaaccuguguugauccccuuaccugauguuaggaauaauuucuaucacuauaaucagucaaaugacccuaccauuaaacugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacgggucccagcggugccuuuguuguucaaccacaaaauggcaggugcacgacugauggcgugcucuuaggcacuacccaacugucuccugucaacaucugcaccuucagaggggaugucacccacauugcagguacucaugauuacacaaugaauuuggcuucucaaaauuggaacaauuacgacccaacagaagaaaucccagccccucugggaacuccagauuucgugggaaagauccaaggcgugcucacucaaaccacaaggggggauggcucgacccguggccacaaagcuacagugagcacugggaguguccacuuuacuccaaagcugggcaguguucaauucaccacugauacaaacaaugauuuugaaacuggccaaaacacgaaauucaccccagucggugucguccaggaugguaauaguacccaccaaaaugaaccccaacaaugggugcucccaaauuacucagguagaacuggccauaauguacaccuagccccugccguagcccccacuuuuccgggugagcaacuucuuuucuucagguccacuaugcccggaugcagcggguaucccaacaugaauuuggauugccuacucccccaggaaugggugcagcacuucuaccaagaggcagcuccagcacaaucugauguggcucugcugagauuugugaauccagacacagguaggguccuguuugagugcaaacuucauaaaucaggcuaugucacaguggcucacacuggccagcaugauuugguuaucccccccaauggcuauuuuagauuugauuccuggguuaaccaauucuacacacuugcccccaugggaaauggagcggggcguagacgugcgcuauaa

SEQ ID NO: 6082 - RNA, 1623 nt, Artificial Sequence
  capsid_protein__Norovirus__ACL27299
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguucacaguguccccuagaaacgcuccaggugagauacuauggagugcgcccuugggcccugauuugaacccuuaccuuucucauuuggccagaauguacaaugguuaugcaggugguuuugaagugcagguaauccuugcggggaacgcguucaccgccggaaaaaucauauuugcagcagucccaccaaacuuuccaacugaaggcuugagccccagccagguuacuauguucccccauaugauaguagauguuaggcaauuggaaccuguguuaaucccuuuaccugauguuaggaacaauuucuaucacuacaaccaaucaaaugacccuaccauuaaauugauagcaaugcuguacacaccacuuagggccaauaaugcuggggaugaugucuucacagucucuugucgaguccucacgaggccauccccugauuuugauuucauauuucugguaccgccaacaguugaaucaagaaccaaaccauucacugucccaaucuuaacuguugaggaaaugaccaauucaagauuccccauuccuuuggaaagguuguacacgggucccagcagugcuuuuguuguccagccacaaaacgguaggugcacgacugauggcgugcucuuaggcacuacccagcugucugcugucaacaucugcaccuuuagaggagaugucacccacauugcaggcucucgcaauuauacaaugaauuuggccucucaaaauuggagcaacuaugacccaacagaagaaaucccagccccccugggaaccccagauuuugugggaaagauccaaggcaugcucacccaaaccacaagaagagauggcucgacccgcggccacaaagccacagugcucacugggagugccgacuuugccccaaaauugggcagaguccaauucgccacugacacagacaacgauuucgaaucuggcgaaaacacgaaauucaccccagucggcgucauccaggaugguuccaccacccaccggaaugaaccccaacaaugggugcucccaaauuauucagguagaacuggucauaaugugcaccuagccccugccguugcccccacuuacccgggugagcaacuccuuuucuucagguccacuaugcccggauguagcggguaucccaacauggaucuagauugcuugcucccccaggaaugggugcggcacuucuaccaagaagcagcuccagcacaaucugauguggcucugcuaagauuugugaauccagacacagguaggguucuguuugagugcaagcuccauaaaucaggguaugucacaguggcucauacuggucagcaugauuuaguuauuccccccaaugguuauuuuagauuugauuccugggucaaccaauuuuacacacucgcccccaugggaaauggagcggggcguagacgugcauuauaa

SEQ ID NO: 6083 - RNA, 1623 nt, Artificial Sequence
  capsid_protein__Norovirus__ACL27300
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguuuacaguguccccuagaaacgcuccaggugagauacuauggagugcgcccuugggcccugauuugaacccuuaccuuucucauuuggccagaauguacaaugguuaugcaggugguuuugaagugcagguaauccuugcggggaacgcguucaccgccggaaaaaucauauuugcagcagucccaccaaacuuuccaacugaaggcuugagccccagccagguuacuauguucccccacauaauaguagauguuaggcaauuggaaccuguguugauccccuuaccugauguuaggaacaauuucuaccacuacaaccaaucaaaugacccuaccauuaaauugauagcaaugcuguacacaccacuuagggccaauaaugcuggggaugaugucuucacagucucuugucgaguccucacgaggccauccccugauuuugauuucauauuucugguaccgccaacaguugaaucaagaaccaaaccauucacugucccaaucuuaacuguugaggaaaugaccaauucaagauuccccauuccuuuggaaagguuguacacgggucccagcagugcuuuuguuguccaaccacaaaacggcaggugcacgacugauggcgugcucuuaggcacuacccagcugucugcugucaacaucugcaccuuuagaggagaugucacccacauugcaggcucucgcaauuauacaaugaauuuggccucucaaaauuggagcaacuaugacccaacagaagaaaucccagccccccugggaaccccagauuuugugggaaagauccaaggcaugcucacccaaaccacaagaagagauggcucgacccgcggccacaaagccacagugcucacugggagugccgacuuugccccaaaauugggcagaguccaauucgccacugacacagacaacgauuucgaaucuggcgaaaacacgaaauucaccccagucggcgucauccaggaugguuccaccacccaccguaaugaaccccaacaaugggugcucccaaauuacucagguagaacuggucauaaugugcaccuagccccugccguugcccccacuuacccgggugagcaacuccuuuucuucagguccacuaugcccggauguagcggguaucccaacauggaucuagauugcuugcucccccaggaaugggugcggcacuucuaccaagaagcagcuccagcacaaucugauguggcucugcuaagauuuguaaauccagacacaggcaggguucuguuugagugcaagcuccauaaaucaggauaugucacaguggcucauacuggucagcaugauuuaguuauuccccccaaugguuauuuuagauuugauuccugggucaaccaauuuuacacacuugcccccaugggaaauggagcggggcguagacgugcauuauaa

SEQ ID NO: 6084 - RNA, 1623 nt, Artificial Sequence
  capsid_protein__Norovirus__ACL31312
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaacgcguucaccgccggaaaaaucauauuugcggcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucgaguucucacgagaccaucccccgauuuugauuuuauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccagauuauucagguagagauagucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6085 - RNA, 1623 nt, Artificial Sequence
  capsid_protein__Norovirus__ACL31313
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaucuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaacuggaaccuguguugauccccuuaccugauguuaggaacaauuucuaucauuacaaucaaucaaaugaucccaccaucaaauugauagcaaugcuguauacgccacuuagggcuaacaaugcuggggacgaugucuucacagucucuugucgaguucuuacgagaccaucccccgauuuugauuucauauuuuuggugccgcccacaguugagucaagaacuaaaccauucucugucccaaucuuaacuguugaggagaugaccaauucaagauucccuauuccuuuggaaaaauuguuuacgggucccagcagugccuuuguuguucaaccacaaaauggcagaugcacgacugauggcgugcucuuagguacuacccaacugucuccugucaacaucugcaccuucagaggggaugucacccacauugcaggcacucaaaacuacacaaugaaucuggccucccaaaauuggaacaauuaugacccaacagaagaaaucccagccccucugggaaccccagauuuuguaggaaagauccaaggcgugcucacccaaaccacaaggggggauggcucgacccgcggucacaaagccacagugagcacuggaaguguccacuuuaccccaaaguugggcaguguucaauucuccacugauacaagcaaugacuuugaaacuggccaaaacacgagguucaccccagucggugucguccaggaugguaguaccacccaccaaaaugaaccccaacaaugggugcucccagcuuauucagguagagacaaccacaauguacaccuagccccugccguggcccccacuuuuccgggugagcaacuucuuuucuuuagguccacuaugcccggaugcagcggguaucccaacaugaauuuggauugccuacucccccaggagugggugcaacacuucuaccaagagucagccccagcacaaucugauguggcauugcugagauuugugaauccagacacagguagggucuuguuugagugcaagcuucauaaaucaggcuauguaacaguggcucacacuggccaacaugauuugguuaucccccccaauggcuauuucagauuugauuccugggucaaccaauucuacacacuugcccccaugggaaauggagcggggcguagacgugcauuauaa

SEQ ID NO: 6086 - RNA, 1623 nt, Artificial Sequence
  capsid_protein__Norovirus__ACL31316
augaagauggcgucgagugacgccaccccaucugauggguccacagccaaccucgucccagaggucaacaaugagguuauggcuuuggagcccguuguuggugccgcgauugcagcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaauggauaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaucaaucaaaugaccccaccaucaaauugauagcaaugcuguauacaccacuuagggcuaacaaugcuggggacgaugucuucacagucucuugccgaguucucacgagaccaucccccgauuuugauuucauauuuuuggugccacccacaguugaaucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcaggcacucaaaauuacacaaugaaucuggccucccaaaauuggaacaacuacgacccaacagaagaaaucccagccccucugggaaccccagauuuuguaggaaagauccaaggcaugcccacccaaacuacaaggggggauggcucgacccgcggucauaaagccacagugagcacuggaaguguccacuucaccccaaagcugggcaguguucaauuuuccacugacacaagcaaugacuuugaaacuggccaaaacacgagauucaccccagucggugucguccaggaugguaguaccacccaccaaaaugaaccccaacaaugggugcucccaaacuauucagguagagacagucacaauguacaucuagccccugccguggcccccacuuuuccgggugagcaacuucuuuucuuuagguccacuaugcccggaugcagcggguaucccaacaugaauuuggauugccuacucccucaggagugggugcagcacuucuaccaagagucagcuccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6087 - RNA, 1623 nt, Artificial Sequence
  capsid_protein__Norovirus__ACL31317
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaauggcaggugcacgacugauggcgugcuccuagguacuacccaacugucuccugucaacaucugcaccuucagaggggaugucacccacauugcaggcacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccagauuauucagguagagauggucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6088 - RNA, 1623 nt, Artificial Sequence
  capsid_protein__Norovirus__ACL31319
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguacuccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaaccaaaccauucucugucccaauuuuaacuguugaggagaugaccaauucaagauuccccauuccuuuggaaagguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaaaauucaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggauggugguaccacccaccaaaaugaaccccaacaaugggugcucccagauuauucagguagagauagucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6089 - RNA, 1623 nt, Artificial Sequence
  capsid_protein__Norovirus__ACL31320
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuugugcaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaagugucaauuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccagauuauucagguagagacagucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6090 - RNA, 1623 nt, Artificial Sequence
  capsid_protein__Norovirus__ACL31322
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucauuacaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagcuccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguaguaccacccaccaaaaugaaccccaacaaugggcacucccagauuauucagguagagauagucacaaugugcaccuagccccugccguggcccccucuuuuccgggugagcaacuucuuuucuucagguccacuaugcccggaugcagcggguaucccaacaugaauuuggauugccuacucccccaggagugggugcagcauuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6091 - RNA, 1623 nt, Artificial Sequence
  capsid_protein__Norovirus__ACL31324
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaucuuucccauuuggccagaauguacaaugguuaugcaggugguuuugaagugcagguaauccucgcggggaacgcguucacugccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugacuccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaaugguaggugcacgacugauggcgugcuccuagguacuacccaacugucuccugucaacaucugcaccuucagaggggaugucacccacauugcaggcacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggauggugguaccacccaccaaaaugaaccccaacaauggguacucccagauuauucagguagagauggucacaaugugcaccuagccccugccguggcccccucuuucccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6092 - RNA, 1608 nt, Artificial Sequence
  capsid_protein__Norovirus__ACL31325
augaagauggcgucgaaugacgccgcuccaucuaaugauggugcagccggucucguaccagaggucaacaaugagaccauggcacuugaaccggugguuggggcuucaauagccgccccacucaccggucaaaacaauguuauagaccccuggauuagauuaaauuuugugcaggcucccaauggagaguuuacaguuucaccccguaauucgccuggggaaguucuacuaaauuuggaauuaggcccugaauugaauccauauuuggcacaccuuucuagaauguacaacgguuaugcaggugggguugaggugcaaguacuacuggcugggacugcguucacggcuggaaaacugguauucgcugcaguucccccucauuuuccauuagaaaacauaagcccuggucaaauaaccauguucccucauguaauuauugauguuagaaccuuagaaccaguuuuauugccucuuccagauguuaggaacaauuucuuccacuacaaucagcaaaaugaaccgaggaugagacuuguggcaaugcuuuauaccccucuuagaucuaaugguucuggugaugauguauuuacugucuccuguagagugcucacucgacccucuccugauuuugauuucaauuaucugguacccccuacaguugaaucuaaaacuaaacccuucacacucccuaucuugacuauaggggaguuaaccaauuccagguucccugugcccauagaugaacucuacacuagccccaaugagaguuuaguggugcaaccccagaacgggagaugcgcgcuggauggggaguugcaggguacuacucagcuccuucccacggcgaucugcucguucaggggucggaucaaucagaaagugaguggagagaaccauguuuggaauaugcaagucaccaacauuaacggaaccccuuuugauccaacagaggacguuccagcuccucuaggcacaccagacuuuucuggcaagcucuuugguguccuaagccagagggaccaugcuaaugccuguaggagucaugaugcagugauugcaacuaauucugcuaaguucaccccaaaauugggcgcuauacaaauuggcacaugggaacaagaugauguacacauuaaccaacccaccaaauuuacuccaguuggcuuguuugaaaaugaagguuucaaccaauggacacuccccaauuauucuggagcuuuaacacucaauaugggguuggcccccccuguggcccccacauucccuggugagcaaauacuuuucuuuagaucccacauuccucuuaaaggagguguggcagacccaguuauugauugucuauugccccaagaguggauccaacaucuuuaucaggagucagccccuucacaaacagauguagcacugauuagauucacaaauccagacacagggcguguucuauuugaagcaaaauugcauaggaguggcuacaucacaguggccaauacugguaguagaccaauuguggugccagcuaaugguuacuuuagguuugacucuuggguuaaucaguuuuauucucucgcccccaugggaacugggaaugggcgcagaagggugcaguaa

SEQ ID NO: 6093 - RNA, 1629 nt, Artificial Sequence
  capsid_protein__Norovirus__ACL31326
augaagauggcgucgaaugacgccgcuccaucaaaugauggugcagcuagucucguaccagagggcguuaaugagacuaugccauuggagcccguugcuggcgcaucuauugcugccccaguggcgggacaaaccaacauaauugaccccuggauaagaacaaauuuuguacaagccccuaauggagaguuuacaguuucaccaagaaacuccccuggagaaauuuuauuaaauuuggaauuaggaccagauuugaauccuuauuuggcccaucuuucaagaauguacaaugguuaugcuggagguguugaggugcaaguacuccuugcugggaacgcguucacagcagguaagauauuguuugcagcaaucccaccuaacuuuccuguagauaugauuagcccagcucaaauuacuaugcuuccccauuugauuguagauguuaggacuuuggaaccuauuaugauacccuugccugauguuaggaauguguucuaucauuuuaauaaucaaccucaaccuagaaugagauuaguggcuaugcuuuauaccccauugaggucuaaugguucaggggaugaugucuuuacugugucuuguagagugcuaacuaggccaacuccugauuuugaguuuaucuaccuggugcccccuucuguagaguccaaaacuaaaccauucacacuaccaauauugaccauuucugaauugaccaacucccgguucccuaucccaaucgagcaauuguauacggccccaaaugagaccaauguuguucagugucagaauggcaggugcaccuuagauggagagcuccagggcacaacucagcuguugucaagugcaguuuguucuuauagaggcaggacuguggccaauaguggggauaauugggaccaaaaucugcuccagcugaccuauccaaauggugcaagcuaugaccccacugaugaaguaccagcaccacugggcacucaagauuuuagugggauguuguauggaguguugacccaggacaaugugaaugugagcacaggagaggccaaaaaugcuaagggaauauacauauccaccacuagugggaaauucaccccaaagaucgggucaauuggauuacauucaauaacugaacaugugcaccccaaucaacagucgcgguucacccccguuggagucgcugugaaugagaacacccccuuucagcaguggguucugccacauuaugcagguagccucgcucucaacaccaauuuggcaccugcuguugccccgacuuucccuggugagcaauugcuguucuucagaucccgugucccauguguucaaggccuacaggggcaggaugcauucauagauugccuccugccccaagagugggugaaucauuuuuaccaagaggcagcccccucccaagcagacgucgcccuuauuagguaugucaacccugauacuggucgcacgcuguuugaagccaaauugcauagaucagguuucauuacugugucacauacuggugcuuacccucuugugguccccccaaauggucauuuuagguuugauucuuggguuaaucaauuuuacucacucgcccccaugggaacuggcaaugggcgcagaaggguccaguaa

SEQ ID NO: 6094 - RNA, 1623 nt, Artificial Sequence
  capsid_protein__Norovirus__ACL31340
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguaucccccagaaacgcuccaggugaaauauuguggagcgcgcccuugggcccugauuugaaucccuaccuuucccauuuguccagaauguauaaugguuaugcaggugguuuugaggugcaggugauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuaccugauguuaggaacaauuucuaccauuacaaucaaucaaaugaccccaccaucaaauugauagcaaugcuguauacaccacuuagggcuaauaaugcuggggacgacgucuucacagucucuugucgaguucucacgagaccauccccugauuuugauuuuauauuuuuggugccacccacaguugagucaagaacuaaaccauucucugucccaaucuuaacuguugaggagaugaccaauucaagauucccuaucccuuuggaaaaguuguucacgggucccagcagugccuuuguuguucaaccacaaaauggcaggugcacgacugauggcgugcucuuagguaccacccaacuguccccugucaacaucugcaccuucagggggaaugucaccaacauugcagguucucaaacuuacacaaugaaucuggccucccaaaauuggaacaauuaugacccaacagaagaaaucccagccccucuggguacuccagauuuuguaggaaagauccaaggcgugcucacccaaaccacaaagggggauggcucgacccgcggucacaaagccacagugagcacuggaagugcccaauuuaccccaaagcugggcaguguucaauucuccacugauacaagcacugacuuugaaacuggccaaaacacgagauucaccccagucggugucauccaggaugguagcaccacccacaaaaaugaaccccaacaaugggugcucccaagcuacucagguagagauagucacaauguacaccuagccccugcuguggccccuacuuuuccgggugagcaaauucuuuucuuuagguccacuaugcccggaugcagcggguaccccaacauggauuuggauugccuacucccccaggagugggugcagcacuucuaccaagagucagccccagcacaaucugauguggcacugcugagauuugugaauccagacacagguaggguuuuguuugagugcaagcuccauaagucaggcuauguaacaguggcucacacuggccaacaugauuuaguuaucccccccaauggcuauuuuagauuugauuccugggucaaccaauucuacacucuugcccccaugggaaauggagcggggcguagacgugcauuauaa

SEQ ID NO: 6095 - RNA, 1623 nt, Artificial Sequence
  capsid_protein__Norovirus__ACL31354
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuauaaucaguuaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugauguggcccuauugagauucgugaauccagacacggguaggguccuguuugagugcaaacuucauaaaucaggcuaugucacaguggcucauaccggccagcaugauuuggucaucccccccaauggcuauuuuagguuugauuccuggguuaaucaauucuacacacuugcccccaugggaaauggaacggggcguagacgugcuuuauaa

SEQ ID NO: 6096 - RNA, 1623 nt, Artificial Sequence
  capsid_protein__Norovirus__ACL31355
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuugugcaagccccugguggagaguucacaguaucccccagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccacaaagcuacaguuuacacugggagugcccccuuuacuccaaaacugggcaguguucaauucaguacugauacagaaaaugauuuugaagcucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6097 - RNA, 1623 nt, Artificial Sequence
  capsid_protein__Norovirus__ACL31356
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauagaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaggugcaggugauccucgcggggaacgcguucaccgccggaaaaauuauauuugcagcagucccaccaaauuuuccaacugaaggucugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccuaacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccacaaagcuacaguuuacacugggagugcccccuuuacuccaaaacugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6098 - RNA, 1623 nt, Artificial Sequence
  capsid_protein__Norovirus__ACL31358
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuugugcaagccccugguggagaguucacaguaucccccagaaacgcuccaggugaaauacuauggagcgcgcccuuaggcccugaucugaaucccuaccuaucucauuuggcuagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuaccgucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucauccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccacaaagcuacaguuuacacugggagugcccccuuuacuccaaaacugggcaguguucaauucaguacugauacagaaaaugauuuugaagcucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucauaccggccagcaugauuuggucaucccccccaauggcuauuuuagguuugauuccuggguuaaucaauucuacacacuugcccccaugggaaauggaacggggcguagacgugcuuuauaa

SEQ ID NO: 6099 - RNA, 1647 nt, Artificial Sequence
  capsid_protein__Norovirus__ACL31361
augaagauggcgucgaaugacgccgcuccaucuaaugauggugccgccggccucgucccagagaucaacaaugaggcaauggcgcuagagccaguggcgggugcagcgauagcagcaccccucacuggucagcaaaauauaauugaucccuggauuaugaauaauuuugugcaagcaccugguggugaguuuacaguauccccuagaaauuccccuggugaaguucuucuuaauuuggaauugggcccagaaauaaaucccuauuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaauguguccacaugugauuguggaugucagacagcuggaaccagucaaccucccaaugccugacguucguaacaacuucuuucauuacaaucaagggucugauucgagauugcgccuaauugcaaugcuguauacaccucuuagggcaaauaauucuggggaugauguuuuuacugugucuugcagagugcuaacuagaccuaguccugacuucucauuuaauuuccuugugccaccuacuguggagucaaagacaaaacccuuuucccucccuauucugacuaucucugaaaugucuaauucuagguucccaguaccaauugauucucugcacaccagcccuacugagaacauuguuguccagugucagaauggacgcgucacccuugauggugaguugaugggcaccacccaacucuuaccuagccaaaucugugcuuucaggggcgugcucaccagaucaacaagcagggccagugaccaggccgauacagcaaccccuagauuguuuaauuauuauuggcauauacaguuggauaaucuaaauggaacuccuuaugacccugcagaagauauaccaggcccccuagggacaccagauuuucggggcaaagucuuuggcguggccagccagagaaauccugauagcacgacuagggcacaugaagcaaagauagacacaacaucuggccguuucaccccaaaacuaggcucauuagagauuuccacugagucugaugauuuugaucaaaacaaaccaacaagauucaccccaguuggcauugggguugaccaugaggcagacuuucaacaaugggcucuucccgacuaugcuggccaguucacccacaacaugaacuuagccccagcuguugcucccaacuuuccuggugagcagcuccuuuucuuccgcucacaguugccaucuucuggugggcgauccaacgggauucuagacugccuggucccccaagaauggguacagcacuucuaccaagaaucagcccccucccaaucucaaguggcccugguuagguauaucaacccugacacugguagaguguuauuugaggccaagcugcacaaauuagguuucauaacuauagccaagaauggugacucuccaauaacugucccuccaaauggauacuuuagguuugaaucuugggugaaccccuuuuauacacuugcccccaugggaacugggaaugggcguagaaggauucaauaa

SEQ ID NO: 6100 - RNA, 1623 nt, Artificial Sequence
  capsid_protein__Norovirus__ACL31365
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauucucgcggggaacgcguucaccgccggaaaaauuauauuugcagcagucccaccaaauuuuccaacugaaggucugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucauaauuacacaaugaauuuagcaucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguaguaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6101 - RNA, 1623 nt, Artificial Sequence
  capsid_protein__Norovirus__ACL36375
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaccacuauaaucagucaaaugauccuaccauuaaauugauagcaaugcuguauacaccacuuagggcuaauaaugcuggggaggaugucuucacagucucuugucgaguucucacgaggccauccccugauuuugauuuuauauuuuuggugccaccuacaguugagucaagaacuaaaccauuuacugucccaauccuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaguuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcgcaggcgugcauuauaa

SEQ ID NO: 6102 - RNA, 1593 nt, Artificial Sequence
  capsid_protein__Norovirus__ACN32270
augaugauggcgucuaaggacgcuacgucaagcguggauggcgccaguggcgcuggucaguugguaccggagguuaaugcuucugacccucuugcaauggauccuguagcgggcucuucaacagcaguugcaacugcugggcaaguuaacccuauugacccuuggauaaucaauaacuuugugcaggcuccccaaggcgaauuuacuauuucuccaaauaauacccccggugauguuuuguuugauuugaguuuaggcccucaucuuaaucccuucuugcuacauuugucacaaauguauaauggcuggguuggcaauaugagaguuaggauuauguuggcuggaaaugcauuuacugcagguaaaauuauaguuucuugcauaccuccuggcuuugguucccauaaccuuacuauagcacaagcaacucuuuucccacaugugauugcugauguuaggacuuuagauccaauugaaguacccuuagaagauguaaggaauguucucuuucauaauaaugacagaaaucaacaaacaaugcgccuugugugcaugcuuuacaccccccuccgcacugguggcgguacaggugauucuuuugugguugcagggcgaguuaugacuuguccuagccccgacuuuaauuucuuauuuuugguuccucccacaguggaacagaagaccaggccuuuuacucucccaaauuuaccgcugaguucuuugucaaauucacgugcuccucuuccaauuaguggcauggguauuucuccagauaauguucagagugugcaguuccaaaauggccgguguaccuuagaugggcgacuuguuggcaccaccccagucucccucucccauguugcuaagauaagggguacuucuaauggcacugugaucaaucucaccgaauuggauggcacccccuuccacccuuuugaaggcccugccccuauugguuucccagaucuugguggcugugauuggcauauuaacaugacacaauuugggcauucuagccagacucaguaugauguggacaccacccccgacaccuucgucccccacuuggguucaauccaggcgaauggcaucaauaguggcaacuacauugguguucuuagcugggucucccccccaucacacccaucuggcucucaaguugaucuuuggaagauccccaacuaugggucuagcaucacagaggcaacccaucuagcucccucugucuuuccuccugguuuuggagagguacuagucuuuuucaugucaaagauaccagguccuggugcuuauagucuacccuguuuacugccacaagaauauauuucacaccucgcaagugaacaagcccccacuguuggugaggccgcccugcuccacuauguugacccugauacaggccggaaucuuggggaguuuaaggcuuacccugaugguuuccuaaccugugucccuaauggggccagcucgggcccacaacaacugccaaucaauggagucuuugucuuuguuucauggguguccagauuuuaucaguuaaagccugugggaacugccagcacggcaagagguaggcuugguuugcgccgauaa

SEQ ID NO: 6103 - RNA, 1608 nt, Artificial Sequence
  capsid_protein__Norovirus__ACT52403
augaagauggcgucgaaugacgcuaguccguccagugacggaucagccaaccucgucccagagaucaauaaugaggugauggcucuugaaccaguggcuggugcugcuauugcugccccgguugcugggcaacaaaauauaauagaucccuggauuagaaauaacuuugugcaggccccugguggugaguucacuguuucaccaagaagcgccccgggggaaguacuucuaaauuuaccucuaagcccugauaucaauccauauuuggcccauuugucccgaauguauaaugguuaugcuggaggcguggagguggaggugguccucgccgggaaugcguucacggcgggaaaaaucaucuuugccgcagugccacccaauuuuccuccugagaaccuuaguccaagucaaauaacaaugcucccccauaucauaguugaugucaggcaauuggaaccagugcgcauacccuuaccagaugugcgcaauaauuucuaucauuauucuagagaaaaugacuccacauugagauugauugcaauguuguacacuccccuuagagcuaauaaugcuggugaugauguguuuacugucucuuguaggguguugacaaggccuucuccugauuuugacuucauauuccuggugccacccacgguugaaucuaaaucuaaaccuuucacuaucccaauacucacuauugaggaaaugaccaauuccagguucccugccccguuagagaugaugaccacagggccgagccacgacauuguugugcaaccacaaaacggacgcugcaccauugauggcgugcugcucggcaccacacaguuguccccaguuaacaucugcuccaugagggguguccccacaaagcgaaccaaugggacugauaauugcuuugugcaacucgagaauccaaacgguucagcuuaugauccaacagaggacauaccagcaguccuggggucaccugacuuugugggagaguucuacgggacaaucacccagaggaguccaaacaauucaacuagggcucacccuuucacccucaacacuggaagcccuagguacacuccuaaaauuggcucaguggacauccacgucacagacguugaagaccucaacgaucacgagccagugaaacucacuccagucggucucucugggagcagugguucaauccaucaguggcagcuaccaaauuacucaggaguggcaacccacaauaugcacuuggccccaucugucgcuccauuguucccuggugagcagauucuuuucuuccgguccacaguccccgggugcggugguuauccaaacacaaacauugacuguuugauuccucaagaguggguucaacacuucuaccaggaaggugcuccagcccguacugauguggcccugcucagauuuauaaacccugacacgggcagagugcucuuugaguguaaauugcauaagcauggcuuuaucacuguggcuuacucuggaaaucaugauuugguuaugcccccaaaugguuacuuuagauuugaaucuugggugaaucaauuucacacucuugcccccaugggaacagguucgggcagaaggagaauccaguaa

SEQ ID NO: 6104 - RNA, 1647 nt, Artificial Sequence
  capsid_protein__Norovirus__ACT52405
augaagauggcgucgaaugacgccacuccaucuaaugauggugccgccggccucgucccagagaucaacaaugaggcaauggcgcuagacccaguggcgggugcagcgauagcagcaccccucacuggucagcagaauauaauugaucccuggauuauggauaauuuugugcaagcaccugguggugaguuuacaguauccccuaggaauuccccuggugaagugcuucuuaauuuggaauugggcccagaaauaaaucccuauuuggcucaucuugcuagaauguauaaugguuaugcagguggauuugaagugcagguaguccuagcuggaaaugcguuuacagcgggaaagauaaucuuugcagcuauacccccuaauuucccaauugauaaucuaagcgcagcacagaucacaaugugcccacacgugaucguggaugucagacaguuggaaccggucaaccucccgaugccugacguucgcaacaacuucuuucauuacaaucaagggucugauucgagauugcgcuuaauugcaaugcuguacacaccucuuagggcaaacaauucuggggaugauguuuuuacugugucuuguagagugcugacuagaccuagcccugacuuuucauuuaauuuccuugugccaccuacuguggagucaaagacaaaacccuucacccucccuauucugacuaucucugaaauguccaauucuagguuuccagugccgauugauucucugcacaccagcccaacugauaauauuguuguccagugccaaaaugggcgcgucacucuugauggugaguugaugggcaccacccaacucuuaccuagucaaaucugugcuuucaggggcgugcucaccagaucgacaagcagggccagugaucaggccgacacagcaaccccuagguuguucaauuauuauuggcacauacaauuggauaaucuaaaugggacuccuuaugauccugcagaagacauaccaggcccccuagggacaccagauuuccggggcaaagucuuuggcguggccagccagagaaaccccgacagcacaacuagagcacaugaagcaaagguggacacaacagcuggucguuuuaccccaaaacuaggcucauuagagauauccacugaaucuaaugacuuugaccaaaaccaaccaacaagauucaccccaguugguauugggguugaccacgaggcagacuuucaacaauggucuuuacccgacuacucuggucaguucacccacaacaugaacuuagucccagcuguugcucccaacuucccuggugagcagcuccuuuucuuccgcucacaguuaccauccucuggugggcgauccaacgggauucuagacugccuggucccccaagaauggguucagcacuucuaccaagaaucggcccccgcccaaacucaaguggcccugguuagguaugucaacccugacacugguagaguauuauuugaggccaagcugcacaaauuagguuucaugacuauagcuaagaauggugacucuccaauaacugucccuccaaauggauacuuuagguuugaaucuugggugaaccccuuuuauacacuugcccccaugggaacugggaaugggcguagaagaaaucaauaa

SEQ ID NO: 6105 - RNA, 1647 nt, Artificial Sequence
  capsid_protein__Norovirus__ACT52407
augaagauggcgucgaaugacgccacuccaucuaaugauggugccgccggccucgucccagagaucaacaaugaggcaauggcgcuagacccaguggcgggugcagcgauagcagcaccccucacuggucagcaaaauauaauugaucccuggauuaugaauaauuuugugcaagcaccugguggugaguuuacaguuuccccuaggaauuccccuggugaagugcuucuuaauuuggaauugggcccagaaauaaaucccuauuugucccaucuugcuagaauguauaaugguuaugcagguggauuugaagugcagguuguccuagcuggaaaugcguuuacagcaggaaagauaaucuuugcagcuauacccccuaauuucccaauugacaauuuaagcgcagcacagaucacaaugugcccacaugugauuguggaugucagacaguuggaaccggucaaccucccgaugccugacguucgcaacaacuucuuucauuacaaucaagggucugauucgagguugcgcuuaauugcaaugcuguauacaccucuuagggcaaauaauucuggggaugauguuuuuacugugucuuguagagugcugacuaggccuagcccugacuuuucauuuaauuuccuugugccaccuacuguggaaucaaagacaaaacccuucacccucccuauucugacuaucucugagauguccaauucuagguuuccagugccgauugauucucugcacaccagcccaacugagaauauuguuguccagugucaaaaugggcgcgucacucuugauggugaguugaugggcaccacccaacucuuaccuagucaaaucugugcuuuuaggggcgugcucaccagaucaacaagcagggccagugaccaggccgacacagcaaccccuagguuguuuaauuacuauuggcacauacaauuggauaaucuaaaugggacuccuuaugacccugcagaagacauaccaggcccccuagggacaccagauuuccggggcaaagucuuuggcguggccagccaaagaaaccccgacagcacaacuagagcacaugaagcaaagguggacacaacagcuggucguuucaccccaaaacuaggcucauuggagauauccacugaaucugaugacuuugaccaaaaccaaccgacaagauucaccccaguuggcauugggguugaccaugaggcagacuuucaacaauggucuuuacccgacuacucuggacaguucacccacaacaugaacuuagccccagcuguugcucccaacuucccuggugagcagcuccuuuucuuccgcucacaguuaccauccucuggugggcgauccaacgggauucuagacugccuggucccccaagaauggguucagcacuucuaccaagaaucggcccccgcccaaacccaaguggcccugguuagguaugucaacccugacacugguagaguauuauuugaggccaagcugcacaaauuagguuucaugacuauagcuaagaauggugacucuccaauaacugucccuccaaauggauacuuuagguuugagucuugggugaaccccuuuuacacacuugcccccaugggaacugggaaugggcguagaagaaaucaauaa

SEQ ID NO: 6106 - RNA, 1608 nt, Artificial Sequence
  capsid_protein__Norovirus__ACT52409
augaagauggcgucgaaugacgccgcuccaucuaaugauggugcagccggucucguaccagaggucaacaacgagacgauggcacucgaaccgguggcuggggcuuccauagccgccccucugaccggucaaaauaauguuauagaccccuggauuagaaugaauuuuguccaagccccaaauggugaauuuacagugucuccccguaacucuccuggugaaauuuuguuaaauuuagaauuagguccugaacugaauccauucuuagcacaucuuucaaggauguacaaugguuaugcugguggaguugaagugcaggugcuacuugccgggaacgcguucacagcaggaaaacuaguguuugcagcaauccccccacauuucccuauugagaaucuuaguccuggacaaauuacaauguucccccaugugaucauugauguuaggacauuagaaccuguacuuuugccccucccagauguuaggaauaguuucuuucauuauaaucaggagccugagccccguaugaggcuuguugcuaugcuguauaccccccuuagaucuaaugguucuggugaugauguguuuacaguuucuuguaggguucuuacucgcccuuccccagauuuugauuucaauuauuugguucccccaacuguugagucuaaaacuaaaccauucacccuaccaaucuugacuauuggagaauugucaaauucuagguucccagcuccaauugaugaacuguauaccagucccaaugaggguuugguuguccaaccccaaaacggcagaucaacacucgacggugaacuguugggcaccacccaacuugugcccucaaacauuugcucacugcgaggacgcaccaaugcccacuugccagacaaccagcaccguuggaacaugcaagucacaaauccaaauggaacucccuucgaccccaccgaagauguuccugcaccgcuggguacaccagacuuccuagcgaacaucuauggagucaccagucagaggaaccccaacaacacuugucgcgcucaugauggaauuuuggcgacuuggagccccaaguucacacccaagcuggggucugugguccugggcacuugggaagacagagauuuugacauaaaccaacccacgagguuuacgccuguugguuuguaugacacugaucacuucaaucaaugggcuuuaccaaauuacucuggagcgcugacucuaaacaugaauuuggcacccuccgucgccccccucuucccaggugagcaguuacuuuucuucaggucccauauaccacucaagggaggcacuucuaauggugcuauugauugccuacucccucaggaauggguucagcacuuuuaccaggagucagcuccauccuccacugacguggcucugaucagguacaccaacccugacacaggacgcguuuuguuugaggccaaauugcauaggcagggauuuaucacagugucaaacucuggcucuagacccauuguuguccccccaaauggcuauuuuagauuugauucuuggguuaaucaauuuuauucucuugcccccaugggaacugggaaugggcgcagaagagugcaguaa

SEQ ID NO: 6107 - RNA, 1623 nt, Artificial Sequence
  capsid_protein__Norovirus__ACT78459
augaagauggcgucgagugacgccaacccaucugauggguccacagccaaccucgucccagaggucaacaaugagguuauggcuuuggagcccguuguuggcgccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaauuauauuugcagcagucccaccaaauuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaacugauagcaauguuguauacaccacuuagggcuaauaaugcuggggacgaugucuucacaguuucuugucggguucucacgagaccaucccccgauuuugauuuuauauuuuuagugccacccacaguugagucaagaacuaaaccauucucugucccaauuuuaacuguugaggagaugaccaauucaagauuccccauucccuuggaaaagcuguucacgggucccagcagugccuuuguuguucaaccacaaaacggcaggugcacgacugauggcgugcuccuaggcaccacccaacugucuccugucaacaucugcacuuucagaggggaugucacccauauuacagguagucguaacuacacaaugaauuuggcuacucaaaacuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagaccaugauuuugaugcuaaccaaaacacaaaguucaccccagucggugucauccaggauggugauacugcccaccgaaaugagccccaacaaugggugcucccaaguuacucaggcagaaauagucacaaugugcaccuggcccccgcuguagcccccacuuuuccaggugagcaacuccucuucuucagauccacuaugcccggaugcagcggguacccuaacauggacuuggacugucugcucccucaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcuuuauaa

SEQ ID NO: 6108 - RNA, 1641 nt, Artificial Sequence
  capsid_protein__Norovirus__ACU56258
augaugauggcgucuaaggacgccccucaaagcgcugauggcgcaagcggcgcaggucaacuggugccggagguuaauacagcugaccccuuacccauggaacccguggcugggccaacaacagccguagccacugcugggcaaguuaauaugauugaucccuggauuguuaauaauuuuguccagucaccgcaaggugaguuuacaauuuccccuaauaauacccccggugauauuuuguuugaucuacaauuagguccacauuuaaacccuuucuugucacauuugucccaaauguauaauggcuggguuggaaacaugagaguuaggauucuccuugcugggaaugcauucucagccggaaagauuauagucuguuguguccccccuggcuucacaucuuccucucucaccauagcucaggcuacauuguuuccccaugugauugcugaugugagaacccuugaaccaauagaaaugccccucgaggacgugcgcaauguccucuaucacaccaaugauaaucaaccaacaaugcggcugguguguaugcuguacacgccgcuccgcacugguggggggucugguaauucugauucuuuuguaguugcuggcagggugcucacggccccuaguagcgacuucaguuucuuguuccuugucccgccuaccauagaacagaagacucgggcuuuuacugugcccaauauccccuugcaaaccuuauccaauucuagguuuccuucccucauccaggggaugauucuguccccugacgcaucucaagugguccaauuccaaaauggacguugucuuauagauggucaacuccuaggcacuacacccgccacaucaggacagcuguucagagugagaggaaagauaaaucagggagcccgcacacucaaucucacagagguggauggcaagccauucauggcauuugauuccccugcaccugugggguuccccgauuuuggaaaaugugauuggcacaugagaaucagcaaaaccccaaauaacacaagcucaggugacccuaugcgcagugucgacgugcaaaccgaugugcaggguuuugugccacaccugggaagcauacaguuugaugaaguguucaaccaucccacaggugacuacauuggcaccauugaauggauuucccagccaucuacacccccuggaacagauauuaauuuaugggagauccccgauuauggaucaucccucucccaagcagcuaaucuggcccccccaguauuccccccuggauuuggugaggcucuuguguacuuuguuucugcuuuuccaggccccaacaaccgcucagccccgaaugaugugccuugucuccucccucaagaguacguaacccacuuugucagugaacaagccccaacgaugggugacgcagcuuugcugcauuaugucgacccugauaccaacagaaaccuuggggaguucaaguuauacccuggagguuaccucaccuguguaccaaacggggugggugccgggccucaacagcuuccccuuaauggugucuuucucuuugucucuugggugucucguuuuuaucagcucaagccugugggaacagccaguacggcaagagguaggcuuggagugcgccguauauaa

SEQ ID NO: 6109 - RNA, 1638 nt, Artificial Sequence
  capsid_protein__Norovirus__ACX33982
augaugauggcgucuaaggacgccccaacaaacauggauggcaccaguggugccggccagcugguaccagaggcaaauacagcugagccuauaucaauggagccuguggcuggggcagcaacagcugccgcaaccgcuggccaaguuaauaugauugaccccuggauaaugaauaauuaugugcaagccccucaaggugaauucacuauaucacccaauaacacaccaggugauguuuuguuugauuugcaauuaggcccccaccuuaacccuuucuugucccauuuggcccaaauguauaaugguuggguuggcaacaugaaagugaagguccuauuggcugguaaugccuucacggcugguaaaauaauuauuagcugcauacccccuggcuuugcugcacaaaauuucucuauugcucaagcuacaauguucccccacgucauagcugauguuagaguccuggaacccauugaggugccauuggaagaugugaggaaugugcuguuucauaacaaugacaacacaccaaccaugagauugguaugcaugcuuuacaccccccugcgagccagugguagcucaucugggacugacccuuuugugauugcagggcgcguuuuaacaugcccaagcccugauuuuagcuucuuauuuuuggucccccccaauguagaacaaaagaccaaacccuuuagugucccaaaucuuccauugaauacucuuucaaauucaagagucccuucucuaaucaaaucaaugaugauaucuagagaucaugggcagaugguccaguuucaaaaugguagagucacacuggaugggcaacugcaaggcaccacgcccacgucagcuagccagcuguguaaaaucagaggcagugucuuccaugcuaauggugggaauggguacaaccuaacugagcuggaugggagcccauaccaugcauuugagagcccugcgccaauaggguuuccagaucuaggugaaugugauuggcauauggaggccucccccaucacccaauucgauacuggugaugucauaaaacaaauuaaugucaagcaagaaucagcauuugccccccaccuugguacggugcaagcggacggccugagugaugugagugccaacacuaauaugauagcuaaauugggauggguaucacccgucagugauggacauaggagugaugucgauccgugggucaucccacgauaugggucgacuuugacugaggccgcccaguuggccccuccaauauaccccccagguuuuggugaagccauuguguucuuuaugucagauuucccuauugcccauggcacuaauggcuugagcgugcccugcaccauaccccaagaauuuguuacccauuuugucaaugaacaagccccuacuagaggggaagcagcccugcuacauuauuuagacccugacacucacagaaaccuuggugaguuuaaauuguacccugaugguuucaugacauguguaccuaauucuaguggcacugguccacaaacccucccaaucaauggugucuuugucuuuguguccuggguuuccagauucuaccaguuaaagccugugggaacagccggcccggcucguaggcuuggaauuaggagaucauaa

SEQ ID NO: 6110 - RNA, 1638 nt, Artificial Sequence
  capsid_protein__Norovirus__ACX33983
augaugauggcgucuaaggacgccccaacaaacauggauggcaccaguggugccggccagcugguaccagaggcaaauacagcugagccuauaucaauggagccuguggcuggggcagcaacagcugccgcaaccgcuggccaaguuaauaugauugaccccuggauaaugaauaauuaugugcaagccccucaaggugaauucacuauaucacccaauaacacaccaggugauguuuuguuugauuugcaauuaggcccccaccuuaacccuuucuugucccauuuggcccaaauguauaaugguuggguuggcaacaugaaagugaagguccuauuggcugguaaugccuucacggcugguaaaauaauuauuagcugcauacccccuggcuuuguugcacaaaauuucucuauugcucaagcuacaauguucccccacgucauagcugauguuagaguccuggaacccauugaggugccauuggaagaugugaggaaugugcuguuucauaacaaugacaacacaccaaccaugagauugguaugcaugcuuuacaccccccugcgagccggugguagcucaucugggacugacccuuuugugauugcagggcgcguuuuaacaugcccaagcccugauuuuagcuucuuauuuuuggucccccccaauguagaacaaaagaccaaacccuuuagugucccaaaucuuccauugaauacucuuucaaauucaagagucccuucucuaaucaaaucaaugaugauaucuagagaucaugggcagaugguccaguuucaaaaugguagagucacacuggaugggcaacugcaaggcaccacgcccacgucagcuagccagcuguguaaaaucagaggcagugucuuccaugcuaauggugggaauggguacaaccuaacugagcuggaugggagcccauaccaugcauuugagagcccugcgccaauaggguuuccagaucuaggugaaugugauuggcauauggaggccucccccaccacccaauucgauacuggugaugucauaaaacaaauuaaugucaagcaagaaucagcauuugccccccaccuugguacggugcaagcggacggccugagugaugugagugccaacacuaauaugauagcuaaauugggauggguaucacccgucagugauggacauaggagugaugucgauccgugggucaucccacgauaugggucgacuuugacugaggccgcccaguuggccccuccaauauaccccccagguuuuggugaagccauuguguucuuuaugucagauuucccuauugcccauggcacuaauggcuugagcgugcccugcaccauaccccaagaauuuguuacccauuuugucaaugaacaagccccuacuagaggggaagcagcccugcuacauuauuuagacccugacacucacagaaaccuuggugaguuuaaauuguacccugaugguuucaugacauguguaccuaauucuaguggcacugguccacaaacccucccaaucaauggugucuuugucuuuguguccuggguuuccagauucuaccaguuaaagccugugggaacagccggcccggcucguaggcuuggaauuaggaggucauaa

SEQ ID NO: 6111 - RNA, 1611 nt, Artificial Sequence
  capsid_protein__Norovirus__ACX81341
augaagauggcgucgaaugacgcuacuccaucugaugauggugcagccggccucgugccagagaucaacaaugagguuauggcucuugaacccgucgcuggggccuccaucgcagcccccguagucggccaacagaauauaauugaucccuggauuagaaauaauuuuguacaagccccugcuggugaauucacaguuuccccuagaaacucuccuggagaacuucuacuugauuuggaauuggguccugaacucaaucccuaucuugcacauuuggccaggauguacaaugggcaugcaggaggaauggaagugcagauaguacuggcugggaaugcguucacagcugguaagauccuauuugcugccaucccgccuagcuuccccuaugaaaauuugucacccgcucaauugacuaugugcccccaugugauaguggaugugaggcaauuagaaccagugcuucugccaaugccagauauaagaaauguuuucuaccacuauaaccagaacaauagucccaaacuuaggcuuguagcuaugcuuuauaccccucugagggcuaacaacucaggugaugacguguucacggugucuugccgcguuuuaacacguccuucuccagauuuccaguucaccuuucuggucccaccuacaguugagucuaaaacuaagaauuucacccuucccguucuuagagucucagagaugacaaacucaagguuccccguuguuuuagaccaaauguauacaagcaggaaugaaaacaucauuguccaaccccaaaacggcaggugcacgacugacggugagcugcuuggcacuaccaucuugcagucugugucuauuugcaacuuuaaaggaacaaugcaggcaaagcugaaugaagaaccacgauaccaacuacaacucaccaacuuggaugggucacccauagauccaacagaugauaugccugccccucuuggcacaccagacuuccaggccauguuauauggcguugcaagccaacgcucuuccauagacaaugccaccagggcacaugaugcacagauugacacugcgggugacacauucgccccgaaaauuggccagguucguuuuaaaucaagcucuaaugauuuugaccuacaugacccuacaaaauucacaccuauuggugucaauguggaugaucagcacccuuuuagacaguggucccugccaaacuaugguggucaccuugcccugaacaaucauuuagcccccgcugugacaccacucuuuccuggcgagcagauuuuguucuucaggucauacauuccgagcgccggaggccacacagacggugcuauggacugcuugcugccccaagaguggguagagcacuucuaccaggaagcggcuccuucccaaucugacauugcacugguaagguucaucaacccugauacaggaagagugcucuuugaagcuaaauugcauaaacaagguuuccucacaauugcagcaucuggagaucacccuauugugaugcccacuaaugguuacuuuagguuugaagcuugggucaacccuuucuacacucucgcccccgugggaacugggucugggcgcaggaggauucaauaa

SEQ ID NO: 6112 - RNA, 1611 nt, Artificial Sequence; identical to SEQ ID NO: 6111
  capsid_protein__Norovirus__ACX81343

SEQ ID NO: 6113 - RNA, 1611 nt, Artificial Sequence
  capsid_protein__Norovirus__ACX81345
augaagauggcgucgaaugacgcuacuccaucugaugauggugcagccggccucguaccagagaucaacagugagguuauggcucuugaacccgucgcuggggccucccuugcagcccccguagucggccaacagaauauaauugaucccuggauuagaaauaauuuuguacaagccccugcuggugaauucacaguuuccccuagaaacucuccuggagaacuucuacuugauuuggaauuggguccugaacuuaaucccuaucuugcacauuuggccaggauguacaaugggcaugcaggaggaauggaagugcagauaguacuggcugggaaugcguucacagcugguaagauccuauuugcugccaucccgccuagcuuccccuaugaaaauuugucacccgcucaauugacuaugagcccccaugugauaguggaugugaggcaauuaaaaccagugcuucugccaaugccagauauaaaaaaugauuucaaccacuauaaccagaaaaauaauaccaaacuuaggcuuguagcuaugcuuuauaccccucugagggcuaacaacucaggugaugacgugugcacggagucuugccgcguuuuaacacguccuucuccagauuuccaguucaccuuucuggucccaccuacaguugagucuaaaacuaagaauuucacccuucccguucuuagagucucagagaugacaaacucaagguuccccguuguuuuagaccaaauguauacaagcaggaaugaaaacaucauuguccaaccccaaaacggcaggugcacgacugacggugagcugcuuggcacuaccaucuugcagucugugucuauuugcaacuuuaaaggaacaaugcaggcaaagcugaaugaagaaccacgauaccaacuacaacucaccaacuuggaugggucacccauagauccaacagaugauaugccugccccucuuggcacaccagacuuccaggccauguuauauggcguugcaagccaacgcucuuccauagacaaugccaccagggcacaugaugcacagauugacacugcgggugacacauucgccccgaaaauuggccagguucguuuuaaaucaagcucuaaugauuuugaccuacaugacccuacaaaauucacaccuauuggugucaauguggaugaucagcacccuuuuagacaguggucccugccaaacuaugguggucaccuugcccugaacaaccauuuagcccccgcugugacaccacucuuuccuggcgagcagauuuuguucuucaggucauacauuccgagcgccggaggccacacagacggugcuauggacugcuugcugccccaagaguggguagagcacuucuaccaggaagcggcuccuucccaaucugacauugcacugguaagguucaucaacccugauacaggaagagugcucuuugaagcuaaauugcauaaacaagguuuccucacaauugcagcaucuggagaucacccuauugugaugcccacuaaugguuacuuuagguuugaagcuuggguuaacccuuucuacacucucgcccccgugggaacugggucugggcgcaggaggauucaauaa

SEQ ID NO: 6114 - RNA, 1611 nt, Artificial Sequence
  capsid_protein__Norovirus__ACX81347
augaagauggcgucgaaugacgcuacuccaucugaugauggugcagccggccucgugccagagaucaacaaugagguuauggcucuugaacccgucgcuggggccuccaucgcagcccccguagucggccaacagaauauaauugaucccuggauuagaaauaauuuuguacaagccccugcuggugaauucacaguuuccccuagaaacucuccuggagaacuucuacuugauuuggaauuggguccugaacucaaucccuaucuugcacauuuggccaggauguacaaugggcaugcaggaggaauggaagugcagauaguacuggcugggaaugcguucacagcugguaagauccuauuugcugccaucccgccuagcuuccccuaugaaaauuugucacccgcucaauugacuaugugcccccaugugauaguggaugugaggcaauuagaaccagugcuucugccaaugccagauauaagaaauguuuucuaccacuauaaccagaacaauagucccaaacuuaggcuuguagcuaugcuuuauaccccucugagggcuaacaacucaggugaugacguguucacggugucuugccgcguuuuaacacguccuucuccagauuuccaguucaccuuucuggucccaccuacaguugagucuaaaacuaagaauuucacccuucccguucuuagagucucagagaugacaaacucaagguuccccguuguuuuagaccaaauguauacaagcaggaaugaaaacaucauuguccaaccccaaaacggcaggugcacgacugacggugagcugcuuggcacuaccaucuugcagucugugucuauuugcaacuuuaaaggaacaaugcaggcaaagcugaaugaagaaccacgauaccaacuacaacucaccaacuuggaugggucacccauagauccaacagaugauaugccugccccucuuggcacaccagacuuccaggccauguuauauggcguugcaagccaacgcucuuccauagacaaugccaccagggcacaugaugcacagauugacacugcgggugacacauucgccccgaaaauuggccagguucguuuuaaaucaagcucuaaugauuuugaccuacaugacccuacaaaauucacaccuauuggugucaauguggaugaucagcacccuuuuagacaguggucccugccaaacuaugguggucaccuugcccugaacaaccauuuagcccccgcugugacaccacucuuuccuggcgagcagauuuuguucuucaggucauacauuccgagcgccggaggccacacagacggugcuauggacugcuugcugccccaagaguggguagagcacuucuaccaggaagcggcuccuucccaaucugacauugcacugguaagguucaucaacccugauacaggaagagugcucuuugaagcuaaauugcauaaacaagguuuccucacaauugcagcaucuggagaucacccuauugugaugcccacuaaugguuacuuuagguuugaagcuugggucaacccuuucuacacucucgcccccgugggaacugggucugggcgcaggaggauucaauaa

SEQ ID NO: 6115 - RNA, 1611 nt, Artificial Sequence; identical to SEQ ID NO: 6114
  capsid_protein__Norovirus__ACX81349

SEQ ID NO: 6116 - RNA, 1611 nt, Artificial Sequence
  capsid_protein__Norovirus__ACX81351
augaagauggcgucgaaugacgcuacuccaucugaugauggugcagccggccucgugccagagaucaacaaugagguuauggcucuugaacccgucgcuggggccuccaucgcagcccccguagucggccaacagaauauaauugaucccuggauuagaaauaauuuuguacaagccccugcuggugaauucacaguuuccccuagaaacucuccuggagaacuucuacuugauuuggaauuggguccugaacucaaucccuaucuugcacauuuggccaggauguacaaugggcaugcaggaggaauggaagugcagauaguacuggcugggaaugcguucacagcugguaagauccuauuugcugccaucccgccuagcuuccccuaugaaaauuugucacccgcucaauugacuaugugcccccaugugauaguggaugugaggcaauuagaaccagugcuucugccaaugccagauauaagaaauguuuucuaccacuauaaccagaacaauagucccaaacuuaggcuuguagcuaugcuuuauaccccucugagggcuaacaacucaggugaugacguguucacggugucuugccgcguuuuaacacguccuucuccagauuuccaguucaccuuucuggucccaccuacaguugagucuaaaacuaagaauuucacccuucccguucuuagagucucagagaugacaaacucaagguuccccguuguuuuagaccaaauguauacaagcaggaaugaaaacaucauuguccaaccccaaaacggcaggugcacgacugacggugagcugcuuggcacuaccaucuugcagucugugucuauuugcaacuuuaaaggaacaaugcaggcaaagcugaaugaagaaccacgauaccaacuacaacucaccaacuuggaugggucacccauagauccaacagaugauaugccugccccucuuggcacaccagacuuccaggccauguuauauggcguugcaagccaacgcucuuccauagacaaugccaccagggcacaugaugcacagauugauacugcgggugacacauucgccccgaaaauuggccagguucguuuuaaaucaagcucuaaugauuuugaccuacaugacccuacaaaauucacaccuauuggugucaauguggaugaucagcacccuuuuagacaguggucccugccaaacuaugguggucaccuugcccugaacaaccauuuagcccccgcugugacaccacucuuuccuggcgagcagauuuuguucuucaggucauacauuccgagcgccggaggccacacagacggugcuauggacugcuugcugccccaagaguggguagagcacuucuaccaggaagcggcuccuucccaaucugacauugcacugguaagguucaucaacccugauacaggaagagugcucuuugaagcuaaauugcauaaacaagguuuccucacaauugcagcaucuggagaucacccuauugugaugcccacuaaugguuacuuuagguuugaagcuugggucaacccuuucuacacucucgcccccgugggaacugggucugggcgcaggaggauucaauaa

SEQ ID NO: 6117 - RNA, 1611 nt, Artificial Sequence
  capsid_protein__Norovirus__ACX81353
augaagauggcgucgaaugacgcuacuccaucugaugauggugcagccggccucguaccagagaucaacaaugagguuauggcucuugaacccgucgcuggggccuccaucgcagcccccguagucggccaacagaauauaauugaucccuggauuagaaauaauuuuguacaagccccugcuggugaauucacaguuuccccuagaaacucuccuggagaacuucuacuugauuuggaauuggguccugaacucaaucccuaucuugcacauuuggccaggauguacaaugggcaugcaggaggaauggaagugcagauaguacuggcugggaaugcguucacagcugguaagauccuauuugcugccaucccgccuagcuuccccuaugaaaauuugucacccgcucaauugacuaugugcccccaugugauaguggaugugaggcaauuagaaccagugcuucugccaaugccagauauaagaaauguuuucuaccacuauaaccagaacaauagucccaaacuuaggcuuguagcuaugcuuuauacuccucugagggcuaacaacucaggugaugacguguucacggugucuugccgcguuuuaacacguccuucuccagauuuccaguucaccuuucuggucccaccuacagucgagucuaaaacuaagaauuucacccuucccguucuuagagucucagagaugacaaacucaagguuccccguuguuuuagaccaaauguauacaagcaggaaugaaaacaucauuguccaaccccaaaacggcaggugcacgacugacggugagcugcuuggcacuaccaucuugcagucugugucuauuugcaacuuuaaaggaacaaugcaggcaaagcugaaugaagaaccacgauaccaacuacaacucaccaacuuggaugggucacccauagauccaacagaugauaugccugccccucuuggcacaccagacuuccaggccauguuauauggcguugcaagccaacgcucuuccagagacaaugccaccagggcacaugaugcacagauugacacugcgggugacacauucgccccgaaaauuggccagguucguuuuaaaucaagcucuaaugauuuugaccuacaugacccuacaaaauucacaccuauuggugucaauguggaugaucagcacccuuuuagacaguggucccugccaaacuaugguggucaccuugcccugaacaaucauuuagcccccgcugugacaccacucuuuccuggcgagcagauuuuguucuucaggucauacauuccgagcgccggaggccacacagacggugcuauggacugcuugcugccccaagaguggguagagcacuucuaccaggaagcggcuccuucccaaucugacauugcacugguaagguucaucaacccugauacaggaagagugcucuuugaagcuaaauugcauaaacaagguuuccucacaauugcagcaucuggagaucacccuauugugaugcccacuaaugguuacuuuagguuugaagcuugggucaacccuuucuacacucucgcccccgugggaacugggucugggcgcaggaggauucaauaa

SEQ ID NO: 6118 - RNA, 1611 nt, Artificial Sequence; identical to SEQ ID NO: 6116
  capsid_protein__Norovirus__ACX81355

SEQ ID NO: 6119 - RNA, 1623 nt, Artificial Sequence
  capsid_protein__Norovirus__ACX85806
augaagauggcgucgagugacgccaacccaucugauggguccacagccaaccuugucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugacuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccagguuacuauguucccccauauaguaguagauguuaggcaauuggaaccuguguugauccccuuacccgauguuaggaauaauuucuaucacuauaaucaaucaaaugaccccaccaucaaauugauagcaauguuguauacaccacucagggcuaauaaugcuggggacgaugucuucacagucucuugucggguucucacgagaccaucccccgauuuugauuucauauuuuuagugccacccacaguugagucaagaacuaaaccauucucugucccaaucuuaacuguugaggagaugaccaauucaagauuccccauuccuuuggaaaaguuguucacgggucccagcagugccuuuguuguucaaccacagaaugguaggugcacgacugauggcgugcuccuagguacuacccaacugucuccugucaacaucugcaccuucagagggaaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacgaggagggauggcucgacccguggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaaugggugcucccaaauuauucagguagagauagucacaaugugcaccuagccccugcuguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagguuugauuccugggucaaccaauucuacacacuugcccccaugggaaauggaacggggcguagacgugcauuauaa

SEQ ID NO: 6120 - RNA, 1647 nt, Artificial Sequence
  capsid_protein__Norovirus__ACX85807
augaagauggcgucgaaugacgccgcuccaucuaaugauggugccgccggccucgucccagagaucaacagugaggcaauggcgcuagagccaguggcgggugcagcgauagcagcaccucucacuggucagcaaaauauaauugaucccuggauuaugaauaauuuugugcaagcaccugguggugaguuuacaguauccccuagaaauuccccuggugaaguucuucuuaauuuggaacugggcccagaaauaaaucccuauuuggcccaucuugcuagaauguacaacgguuaugcagguggauuugaagugcaggugguccuagcuggaaaugcgcuuacagcaggaaagauaaucuuugcagcuauuccccccaauuuuccaauugacaaucuaagugcagcacagaucacaaugugcccacaugugauuguggaugucagacaguuggaaccagucaaccucccgaugccugacguucgcaauaauuucuuucauuacaaucaagggucugauucgagauugcgccuaauugcaaugcuauacacaccucuuagggcaaauaauucuggggaugauguuuuuacugugucuugcagagugcuaacuagaccuaguccugacuucucauuuaauuuccuugugccaccuacuguggagucaaaaacaaaacccuuuucccucccuauucugacuaucucugaaauguccaauucuagguucccaguaccaauugauucucugcacacuaguccuacugagaauauuguuguccagugccagaaugggcgugucacccuugauggugaguugaugggcaccacccaacucuuaccuagccaaaucugugcuuucaggggcguucucaccagaucaacaagcagggccagugaccaggccgauacagcaaccccuagauuguuuaauuauuauuggcacauacaauuggauaaucuaaauggaacuccuuaugauccugcagaagacauaccaggcccccuagggacaccagauuuccggggcaaagucuuuggcguggccagccagagaaauccugaugccacgacuagggcacaugaagcaaagauagacacaacaucuggccguuucaccccaaaauuaggcucauuagagauauccacugaaucugaugauuuugaucaaaacaaaccaacaagauucaccccaguuggcauugggguugaccaugaggaagacuuucaacaauggacucuacccgacuacgcuggccaguucacccacaacaugaacuuagccccagcuguugcucccaauuucccuggugagcagcuccuuuucuuccgcucacaguugccaucuucuggugggcgauccaacgggauucuagacugccuggucccccaagaaugggugcagcacuucuaccaggaaucagcccccucccaaacucaaguggcccugguuagguauauuaacccugacacugguagaguguuauuugaggccaagcugcauaaauuagguuucaugacuauagccaagaauggugacucuccaauaacugucccuccaaauggauacuuuagguuugaaucuugggugaaccccuucuacacacuugcccccaugggaacugggaacgggcguagaagaauucaauaa

SEQ ID NO: 6121 - RNA, 1623 nt, Artificial Sequence
  capsid_protein__Norovirus__ACX85809
augaagauggcgucgaaugacgcagcuccaucuaaugauggugcagcaggccucguaccagagaucaacaaugaggucaugccccuugagcccguggcuggugcaucgcuggcuacaccaguugucgggcaacaaaacauaauugaucccuggauaagaaauaauuuuguacaagcuccugcaggugaguuuacaguuuccccuagaaauuccccuggugaaauuuugcuugauuuggaguugggaccagaauugaaccccuaucucgcucaucuggcccgcauguacaaugggcacgcugguggcauggaagugcaaauuguguuggcugggaaugcguucacagcuggcaagaucauauuugcugccaucccuccaggguucccauaugaaaauuugucaccuucacaaauuacaaugugcccucauguuauaauugauguaagacaauuagaaccaguccuucuaccuaugccagauaucagaaauaacuucuuccauuacaaucagggcaaugauccaaaauugagguugauagcuaugcucuacaccccuuuaagggcuaauaauucuggagaugauguguucacaguuucuuggaggggccuuacuaaaacgucaccugauuuugaauucacauuuuugguuccuccuacgguugaaucuaagaccaaacaguucacauugcccauccucaaaauaucagagaugaccaacucaagauucccagugccaguggaaaugauguacacagccaggaaugagaaccaaguuguccagccacagaaugguagggucacacuugauggcgagcuauuagguaccacacccuuguuggcugucaacaucugcaaauucaagggggagguuauagcuaagaauggagaugugagauccuauaggauggacauggaaauuaccaacacugauggcaccccaauugaccccacagaagacacaccuggucccauugguucaccugacuuucaaggcauacucuuugguguugccagccaacgcaacaagaaugagcaaaaccccgccacgagagcccaugaagccaacauuaacacugguggggaccaauaugcccccaaauuggcccaagugaaauucuucucagagucccaggauuucgaggugcaccagcccacaguuuucaccccgguugguguggcaggcgacacuucccacccuuucagacaguggguccugccucgauacgguggacaucucaccaacaacacccacuuggcuccagcaguggccccccuauucccaggugagcagauccuauucuuuagaucacaaauacccagcucaggcggccaugaauuggguuacauggacugccuugucccacaagaauggguccaacacuucuaucaagaagcugccacagcucagucugagguggcacucauaagguucaucaacccagacacuggcagaguccucuuugaggccaagcugcacaagcaaggcuuuauaacuguggcucacacuggugauaacccaauugucaugccaccaaauggguacuuuagauuugaagccuggguuaaucaguuuuacucacucgcccccgugggaacugggaacgggcgcaggagaauccaauaa

SEQ ID NO: 6122 - RNA, 1623 nt, Artificial Sequence
  capsid_protein__Norovirus__ACX85810
augaagauggcgucgaaugacgcagcuccaucuaaugauggugcagcaggccucguaccagagaucaacaaugaggucaugccccuugagcccguggcuggugcaucgcuggcgacaccaguugucgggcaacaaaauauaauugaucccuggauaagaaacaauuuuguacaagcuccugcaggugaguuuacaguuuccccuagaaauuccccuggugaaauuuugcuugauuuggaguugggaccagaacugaaccccuaucucgcucaucuggcccguauguacaaugggcacgcugguggcauggaagugcaaauuguguuggcugggaacgcguucacagcuggcaagaucauauuugcugccaucccuccaggguucccauaugaaaauuugucaccuucacaaaucacaaugugcccucauguuauaauugauguuagacaauuagaaccaguucuacuaccuaugccagauaucagaaacaacuucuuccauuacaaucagggcaaugauccaaaauugagauugauagcuaugcucuacaccccuuuaagggcuaacaauucuggugaugauguguucacaguuucuuguaggguccuuacuaaaccgucaccugauuuugaauuuacauuuuuaguucccccuacgguugaauccaagaccaagcaguucacacugcccauccucaaaauaucagagaugaccaacucaagguucccagugccaguggaaaugauguacacagccaggaaugagaaccaaguuguccagccacagaaugguagggucacacuugauggcgagcuacuaggcaccacacccuugcuggcugucaacaucuguaaauucaagggagagguuauagccaagaauggagaugugagauccuauaggauggacauggaaaucaccaacacugauggcaccccaauugaccccacagaagauacaccuggucccauugguucaccugauuuucaagguauacucuuuggcguugccagccaacgcaacaagaaugagcaaaaccccgccacgagagcccaugaagccaacauuaacacugguggggaccaauaugcucccaaauuggcccaagugaaauucuuuucagagucccaggauuucgaggugcaccaacccacaguuuucaccccaguugguguggcaggugacacuucccacccauucagacaguggguccugccucgauacgguggacaucucaccaacaauacccacuuggcuccagcaguggccccccuauucccaggggagcagauucuauucuuuagaucacaaauaccuaguucaggcggccaugaauuggguuacauggacugccuugucccacaagaauggguccaacacuucuaucaagaagcugccgcagcucagucugagguggcacucauaagguucaucaacccagacacuggcagaguccucuuugaggccaagcugcacaagcaaggcuuuauaacuguggcucacacuggugacaacccaauugucaugccaccaaauggguacuuuagguuugaagccuggguuaaucaguuuuacucacucgccccggugggaacugggaaugggcgcaggagaauccaauaa

SEQ ID NO: 6123 - RNA, 1569 nt, Artificial Sequence
  capsid_protein__Norovirus__ACY41155
augaagaugacugacagagacacuacugaccccgcuccggcgcucggacagguccucccuccagagguugaggcguccguucccguugagccgacugcuggcgcuccuguagccgccgccacugcuggacaagucaauccaauugacccauggauuuuugccaauuuugugcaggcuccccagggggaguuuaccauaucccccaacaauaauccuggugaaaucuuguuugagcuugaauugggcccugaauugaacccuuaccuugcucaccuccgccgcauguacaacggcuggaccggauccaugcgcgugcggguccuccuggcggggaaugccuucucagcuggcaagguggugguguuuuguguucccccuggguuugacgccuccuauuugaccccgucccaggcuacccaguuuccucauguguugauugaugugcgugccccagagcccguugagaugccccuugaggauguucguaacaucuuguuccaccaggggccugauucccgcaugcggcugauggggaugcuguacacccccuugcgcgccaauucuggcgcagacccuuuuguuguuaccggccgggugcuuacuuguccuagccccaacuuuucuuucuucuuucugguuccccccaccgucgaggaaagagagguuccauucacccugccaaauuugccuguuaauaaucuuucccauucucgaguuauggagccgaucgcccagaugaugagcucucgcaaucuuccagccucaguccaguuccaaaauggccgcugcacccuugcuggugaccuuuugggcacgaccccaucaucuccugcugaucugggcacuuuuguugguuugauugcugagccuggcuccaggguuguugagcuguuucagcccaaccaggaagauuuucaugcgggaucugccccugccccgcuugguuuuccagauuuuucugauuguucucuuacuuuugugguggcuaguucgacgacuguuggggaacgcacugucaauucccgcucuccccagaauuucacuccugcucuugggcauguuacucuugaugaggaggcgccagcugauuuguuccgugcucgccuccgaaaccucugggacccaacugagcacuccuucuggaggaucccagacuaccgggccgaugugcuugguucugaguuugcccccucuguuuccgcuccagguguuggugagacucuccucuuuuucaugugcaacguuccucgcuugaauggggcuaaccccaauccuugucccuguuugcucccccaagaguggaucacccauuuuguuucugaacgcgccgcccuccaaggcgauguagcgcugcuaaauuauguuaaccccaacaccggccggguccuguucgagugcaagcucuacgccaacggcuuccuuacuguuaaccuuggcgccucggaccaagcgacccugcccguggaugggauauuuaaauuuguuuccuggguuucuuucuauuaccaguugcggccugugggaaaugcuaguguuggccgccgucuuccccguuugaauggcuucuga

SEQ ID NO: 6124 - RNA, 1623 nt, Artificial Sequence
  capsid_protein__Norovirus__ADA77528
augaagauggcguccaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaaugcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccagguacucguacuuacagaaugaauuuggcuucucaaaauuggaacaauuaugacccaacagaagagaucccagccccucugggaacuccagauuucgugggaaagauccaaggcaugcucacccaaaccacaaagggagacggcucgacccgcggucacaaagcuacagugagcacugggaguguugacuucacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacugcucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuuguaaauccagacacagguaggguucuguuugagugcaagcuacauaaagcaggcuaugucacaguggcucacacuggccagcaugauuugguuaucccccccaauggcuacuuuagauuugauuccugggucaaccaguucuacacacuugcccccaugggaaauggagcggggcgcagacgugcuuuauaa

SEQ ID NO: 6125 - RNA, 1620 nt, Artificial Sequence
  capsid_protein__Norovirus__ADB22512
augaagauggcgucgaaugacgccgcuccaucuaaugauggugcuacaggucucguaccagaggucaacacugagaccuugccucucgagcccguggccggagcggcaauugcugccccuguuacgggccaaaauaauauaauugaucccuggauuagaagcaauuuugugcaggcgccuaauggugaauuuacagucuccccuagaaauuccccuggugaaauuuuaaugaauuuggaguuagggccagaucuuaauccauauuuggcucaccuuucaagaauguacaaugguuaugcuggagguguagaagugcaagugcuccuagcugggaaugcguucacggcaggaaagauccuuuuugcagcaguccccccaaauuuucccguugauaugcucagcccugcucaaaucacaaugcuuccccauuuaauuguagaugucagaacuuuggagccuauuaugaucccucugcccgauguuaggaauguguucuaucacuuuaauaaccagccugccccaagaaugagauugguugccaugcucuacaccccuuuaagauccaauggguccggugaugauguauucacugucuccugcagggugcuaaccagaccuacuccggacuuugaguuuacauacuuagucccccccucgguagaguccaaaaccaagccuuucacccuacccauccuaacaauuggagaguugacaaauucuagguucccagccccgaucgaucaguuguacacuucacccaacgcugauguaguuguucaaccccaaaauggccggugcacacuggacggugagcuacaagguacaacacaacuuuugacaacagcaauaugcucauacaggggcaugacaucaaaccccacuagugauuacugggauggucaccuccugcaccugguccaccccaauggggcaacauaugacccgaccgaggacgugccagcuccuuuuggcacgcaggacuuucggggcauucuguaugggauguugacucaaaacccccgaaccuccggggacgaagccgccaacucccauggugucuacaucucauccaccagugaaaaguucacuccaaaauuggguacaauuggcuuacaccaagugcaaggcgaccauagccagcaacaacagucaaaauucacgccaguagggauagcagugaauggcaacacuccuuucagacagugggaacucccaaacuacucuggugcucucacccucaacacaaaccuugcaccagcgguugggcccaacuucccuggggagcaaauccuuuucuucaggucaaauguuccaaguguucaagguggccaaccuauagagauugauugccugaucccacaagaaugggucucccauuucuaucaagaaucagcccccucucagagugauguggccuuggucagguaugucaacccugacacagggcgcacaaucuuugaggccaaauugcauaggcagggauuuaucaccauagcggccacuggaagcaaccccguggucgugccucccaauggauauuucagauuugauucaugggucaaccaguuuuaugcacucgcccccaugggaacugggaaugggcgcagaaggauucaguaa

SEQ ID NO: 6126 - RNA, 1623 nt, Artificial Sequence
  capsid_protein__Norovirus__ADC91993
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccuaauuuuccaaccgaaggcuugagucccagccaggucacuauguucccccacauaauaguggauguuaggcaauuggaaccuguguugauucccuuaccugauguuaggaauaacuucuaucacuauaaucagucaagugauucuaccauuaaauugauagcaaugcuguacacaccacuuagggcuaauaaugcuggggaagacgucuuuacagucucuugccgaguucucacgaggccauccccugauuuugauuuuauauucuuggugccaccuaccguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggagaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagaugguucgacccguggccacaaagcuacaguuuacacugggagugcccccuucacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccaaaaugugcaccuagccccugcuguagcccccacuuuuccgggugaacaacuucuuuucuuuagguccacuaugcccggaugcagcggguaucccaacauggauuuggauugccuacucccccaggagugggugcaacacuucuaucaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6127 - RNA, 1623 nt, Artificial Sequence
  capsid_protein__Norovirus__ADC91994
augaagauggcgucgaaugacgccaccccaucugauggguccacagccaaccucgucccagaggucaacaaugagguuauggcuuuggagcccguuguuggugccgccauugcggcaccuguagcgggccaacaaaauguaauugaccccuggauuagaaacaauuuugugcaagccccugguggagaguuuacaguauccccuagaaacgcuccaggugaaauacuguggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagucccagccaggucacuauguucccccacauaauaguagauguuaggcaacuggaaccuguguugauucccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucucccgauuuugauuucauauuuuuagugccacccacaguugagucaagaaccaaaccauucucugucccaauuuuaacuguugaggagaugaccaauucgagauuccccauuccuuuggaaaaguuguucacgggucccagcagugccuuuguuguucaaccacaaaacggcaggugcacgacugauggcgugcuccuagguacuacccaacugucuccugucaacaucugcaccuucagaggggaugucacccauaucacagguagucguaacuacacaaugaauuuggcuacucaaaauuggaauaguuaugacccaacagaagaaaucccagccccucuaggaacuccagauuucguggggaagauccaaggugugcucacccaaaccacaagggcagauggcucgacccgcggccacaaagcuacaguguacacugggagcgccgauuuuucuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagaucuacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccucccaaugguuacuuuagauuugauuccugggucaaccaguucuacacacuugcccccaugggaaauggaacggggcguagacgugcauuauaa

SEQ ID NO: 6128 - RNA, 1611 nt, Artificial Sequence; identical to SEQ ID NO: 6114
  capsid_protein__Norovirus__ADE28701

SEQ ID NO: 6129 - RNA, 1644 nt, Artificial Sequence
  capsid_protein__Norovirus__ADE28721
augaagauggcgucgaaugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucaccgucucaccgaggaacucgccuggugagaugcuauuaaaucuugaauugggcccagaacucaacccuuaccuaagucaccugucccguauguauaauggguaugcugguggcaugcagguucaggugguccuagcugggaaugcguucacagcugggaaaaucaucuuugccgccguaccaccacauuuucccguagaaaacauuagugcagcucaaauaacuaugugcccccauguaauuguugaugugagacaacuugaaccaguacuucugccccuuccugacauaaggaacagguucuuucauuacaaucaggagaacaccccccggaugagacuuguggcuaugcucuacaccccccugagggccaacucuggugaagauguguuuacugucucuuguagggucuugacccguccugccccugauuuugaauuuacuuucuugguaccaccaacuguugaaucaaagacuaaaccuuucacacugcccauacuaacucuuggugagcuaucuaacuccagauucccagccccaauagauauguuguacccugaccccaaugagggaauugugguccaaccacaaaaugguaggugcacucuugauggcacucugcaaggcaccacacaacugguccccacccaaauuugugcuuucaggggcacacuaauuggccaaacaucaagaucuucagacucaaccgacucagccccucggagaagggaucacccacuccaugugcaauuaaagaaccuugauggcacgcaguacgacccaacugaugaagugccagcaguccuuggugccauugacuucaaggggacugucuuugggguggccagucagagagacgugucagggcaacaagugggagcaacucgagcccaugaagugcacaucaacacaaccgauccuagguauacaccaaaacugggauccauucucaugcacucagagucggacgacuuugugacuggacagccgguccgcuucacacccauaggaaugggugacaacgacuggcaccagugggagcugccugacuacucuggacaccuaacccugaacaugagccucgccccagcagucgcuccugcuuuuccgggcgagaggauucuuuucuucaggucaauaguuccgucugcugguggcuaugggucuggcuauauagauugccucauaccacaggaguggguucagcauuucuaccaggaagcugcaccaucccaaucugccguggcacucauuagguaugucaauccugacacaggcagaaacaucuuugaggcuaaauugcacagggaagguuucaucaccguggcaaauucugguaacaaccccauuguuguccccccuaauggguauuuuagguuugaggcuugggugaaucaauuuuacacuuugacccccaugggaacuggucaggggcguaggaggaaucaauaa

SEQ ID NO: 6130 - RNA, 1644 nt, Artificial Sequence
  capsid_protein__Norovirus__ADE28722
augaagauggcgucgaaugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucaccgucucaccgaggaacucgccuggugagaugcuauuaaaucuugaauugggcccagaacucaacccuuaccuaagucaccugucccguauguauaauggguaugcugguggcaugcagguucaggugguccuagcugggaaugcguucacagcugggaaaaucaucuuugccgccguaccaccacauuuucccguagaaaacauuagugcagcucaaauaacuaugugcccccauguaauuguugaugugagacaacuugaaccaguacuucugccccuuccugacauaaggaacagguucuuucauuacaaucaggagaacaccccccggaugagacuuguggcuaugcucuacaccccccugagggccaacucuggugaagauguguuuacugucucuuguagggucuugacccguccugccccugauuuugaauuuacuuucuugguaccaccaacuguugaaucaaagacuaaaccuuucacacugcccauacuaacucuuggugagcuaucuaacuccagauucccagccccaauagauauguuuuacacugacccaaaugagggaauugugguccacccacaaaaugguaggugcacucuugauggcacucugcaaggcaccacacaacugguccccacccaaauuugugcuuucaggggcacacuaauuggccaaacaucaagaucuucagacucaaccgacucagccccucggagaagggaucacccacuccaugugcaauuaaagaaccuugauggcacgcaguacgacccaacugaugaagugccagcaguccuuggugccauugacuucaaggggacugucuuugggguggccagucagagagacgugucagggcaacaagugggagcaacucgagcccaugaagugcacaucaacacaaccgauccuagguauacaccaaaacugggauccauucucaugcacucagagucggacgacuuugugacuggacagccgguccgcuucacacccauaggaaugggugacaacgacuggcaccagugggagcugccugacuacucuggacaccuaacccugaacaugaaccucgccccagcagucgcuccugcuuuuccgggcgagaggauucuuuucuucaggucaauaguuccgucugcugguggcuaugggucuggcuauauagauugccucauaccacaggaguggguucagcauuucuaccaggaagcugcaccaucccaaucugccguggcacucauuagguaugucaauccugacacaggcagaaacaucuuugaggcuaaauugcacagggaagguuucaucaccguggcaaauucugguaacaaccccauuguuguccccccuaauggguauuuuagguuugaggcuugggugaaucaauuuuacacuuugacccccaugggaacuggucaggggcguaggaggaaucaauaa

SEQ ID NO: 6131 - RNA, 1644 nt, Artificial Sequence
  capsid_protein__Norovirus__ADE28723
augaagauggcgucgaaugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucaccgucucaccgaggaacucgccuggugagaugcuauuaaaucuugaauugggcccagaacucaacccuuaccuaagucaccugucccguauguauaauggguaugcugguggcaugcagguucaggugguccuagcugggaaugcguucacagcugggaaaaucaucuuugccgccguaccaccacauuuucccguagaaaacauuagugcagcucaaauaacuaugugcccccauguaauuguugaugugagacaacuugaaccaguacuucugccccuuccugacauaaggaacagguucuuucauuacaaucaagagaacaccccccggaugagacuuguggcuaugcucuacaccccccugagggccaacucuggugaagauguguuuacugucucuuguagggucuugacccguccugccccugauuuugaauuuacuuucuugguaccaccaacuguugaaucaaagacuaaaccuuucacacugcccauacuaacucuuggugagcuaucuaacuccagauucccagccccaauagauauguuguacacugacccaaaugagggaauugugguccaaccacaaaaugguaggugcacucuugauggcacucugcaaggcaccacacaacugguccccacccaaauuugugcuuucaggggcacacuaauuggccaaauaucaagaucuucagacucaaccgacucagccccucggagaagggaucacccacuccaugugcaauuaaagaaccuugauggcacgcaguacgacccaacugaugaagugccagcaguccuuggugccauugacuucaaggggacugucuuugggguggccagucagagagacgugucagggcaacaagugggagcaacucgagcccaugaagugcacaucaacacaaccgauccuagguauacaccaaaacugggauccauucucaugcacucagagucggacgacuuugugacuggacagccgguccgcuucacacccauaggaaugggugacaacgacuggcaccagugggagcugccugacuacucuggacaccuaacccugaacaugaaccucgccccagcagucgcuccugcuuuuccgggcgagaggauucuuuucuucaggucaauaguuccgucugcugguggcuaugggucuggcuauauagauugccucauaccacaggaguggguucagcauuucuaccaggaagcugcaccaucccaaucugccguggcacucauuagguaugucaauccugacacaggcagaaacaucuuugaggcuaaauugcacagggaagguuucaucaccguggcaaauucugguaacaaccccauuguuguccccccuaauggguauuuuagguuugaggcuugggugaaucaauuuuacacuuugacccccaugggaacuggucaggggcguaggaggaaucaauaa

SEQ ID NO: 6132 - RNA, 1644 nt, Artificial Sequence
  capsid_protein__Norovirus__ADE28724
augaagauggcgucgaaugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucaccgucucaccgaggaacucgccuggugagaugcuauuaaaucuugaauugggcccagaacucaacccuuaccuaagucaccugucccguauguauaauggguaugcugguggcaugcagguucaggugguccuagcugggaaugcguucacagcugggaaaaucaucuuugccgccguaccaccacauuuucccguagaaaacauuagugcagcucaaauaacuaugugcccccauguaauuguugaugugagacaacuugaaccaguacuucugccccuuccugacauaaggaacagguucuuucauuacaaucaggagaacaccccccggaugagacuuguggcuaugcucuacaccccccugagggccaacucuggugaagauguguuuacugucucuuguagggucuugacccguccugccccugauuuugaauuuacuuucuugguaccaccaacuguugaaucaaagacuaaaccuuucacacugcccauacuaacucuuggugagcuaucuaacuccagauucccagccccaauagauauguuguacacugacccaaaugagggaauugugguccaaccacaaaaugguaggugcacucuugauggcacucugcaaggcaccacgcaacugguccccacccaaauuugugcuuucaggggcacacuaauuggccaaacaucaagaucuucagacucaaccgacucagccccucggagaagggaucacccacuccaugugcaauuaaagaaccuugauggcacgcaguacgacccaacugaugaagugccagcaguccuuggugccauugacuucaaggggacugucuuuggaguggccagucagagagacgugucagggcaacaagugggagcaacucgagcccaugaagugcacaucaacacaaccgauccuagguauacaccaaaacugggauccauucucaugcacucagagucggacgacuuugugacuggacagccgguccgcuucacacccauaggaaugggugacaacgacuggcaccagugggagcugccugacuacucuggacaccuaacccugaacaugaaccucgccccagcagucgcuccugcuuuuccgggcgagaggauucuuuucuucaggucaauaguuccgucugcugguggcuaugggucugacuauauagauugccucauaccacaggaguggguucagcauuucuaccaggaagcugcaccaucccaaucugccguggcacucauuagguaugucaauccugacacaggcagaaacaucuuugaggcuaaauugcacagggaagguuucaucaccguggcaaauucugguaacaaccccauuguuguccccccuaauggguauuuuagguuugaggcuugggugaaucaauuuuacacuuuggcccccaugggaacuggacaggggcguaggaggaaucaauaa

SEQ ID NO: 6133 - RNA, 1647 nt, Artificial Sequence
  capsid_protein__Norovirus__ADK23787
augaagauggcgucgaaugacgccacuccaucuaaugauggugccgccggccucgucccagagaucaguaaugaggcaauggcgcuagauccaguggcgggugcagcgauagcagcgccccucacuggucagcaaaauauaauugaucccuggauuaugaauaauuuugugcaagcaccugguggugaguuuacaguauccccuaggaauuccccuggugaagugcuucucaauuuggaauugggcccagaaauaaaucccuauuuggcccaucuugcuagaauguauaaugguuaugcagguggguuugaagugcagguaguccuagcuggaaaugcguuuacagcaggaaagauaaucuuugcagcuauacccccuaauuucccaauugauaaucuaagcgcagcacagaucacaaugugcccacaugugauuguggaugucagacaguuggaaccggucaaccuuccgaugccugacguucgcaauaacuucuuccacuacaaccaagggucugauucgagauugcgcuuaguugcaaugcuguauacaccucuuagggcaaauaauucuggggaugauguuuuuacugugucuuguagggugcugacuaggccuagcccugacuuuucauuuaauuuccuugugccaccuacuguggagucaaagacaaaacccuucacccucccuauucugacuaucucugaaauguccaauucuagguuuccagugccgauugauucucugcacaccagcccaacugaaaauguuguuguccagugccaaaauggacgcgucacucuugauggugaguugaugggcaccacccaacucuuaccuagucaaaucugugcuuuuaggggcgugcucaccagaucaacaagcagggccagugaccaggccgacacagcaaccccuagguuguuuaauuauuauuggcacauacaauuggauaaucuaaaugggacuccuuaugauccugcagaagacauaccaggcccccuagggacaccagauuuccggggcaaagucuuuggcguggccagccagagaaaucccgacagcacaacuagagcacaugaagcaaagauagacacaacagcuggucguuuuaccccaaaacuaggcucauuagagauauccacugaaucuggugacuuugaucaaaaccaaccaacaagauucaccccaguuggcauugggguugaccacgaggcagauuuccaacaauggucuuuacccgacuauucuggucaguucacccacaacaugaacuuagccccagcuguugcucccaacuucccuggugagcagcuccuuuucuuccgcucacaguuaccaucuucuggugggcgauccaacgggauucuagacugccuggucccccaagaauggguucagcacuucuaccaagaaucggcccccgcccaaacucaaguggcccugguuagguaugucaacccugacacugguagaguguuguuugaggccaagcugcacaaauuggguuucaugacuauagcuaagaauggugacucuccaauaacuguccccccaaauggauacuuuagguuugaaucuugggugaacccauuuuauacacuugcccccaugggaacugggaaugggcguagaaggauucaauaa

SEQ ID NO: 6134 - RNA, 1623 nt, Artificial Sequence
  capsid_protein__Norovirus__ADM52743
augaagauggcgucgaaugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcggcagucccaccaaauuucccaacugaaggcuugagccccagccaggucacuauguucccccacauaauaguagauguuaggcaacuggaaccuguguugauccccuuacccgauguuaggaauaauuucuaucacuauaaucaaucaaaugaccccaccaucaaauugauagcaauguuguauacaccacuuagggcuaauaaugcuggggacgaugucuucacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggccacaaagcuacaguguacacugggagcgccgacuuugcuccaaaacuggguagaguucaauuugccaccgacacagacaaugauuuugaugcuaaccaaaacacaaaguucaccccagucggugucauccaggaugguaauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggacuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuucagauuugauuccugggucaaccaguucuacacacuugcccccaugggaaauggaacggggcguagacgugcauuauaa

SEQ ID NO: 6135 - RNA, 1623 nt, Artificial Sequence
  capsid_protein__Norovirus__ADR57234
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauucucgcggggaaugcguucaccgccggaaaaaucauauuugcagcagucccaccaaauuucccaacugaaggcuugagccccagccaggucacuauguucccccauauaauaguggauguuaggcaauuggaaccuguguugauccccuuacccgauguuaggaauaauuucuaucacuacaaucaauuaaaugaccccaccaucaaauugauagcaauguuguauacaccacuuagggcuaauaaugcuggggacgaugucuucacaguuucuugucgaguucuuacgagaccaucccccgauuuugauuucauauuuuuggugccaccuacaguugagucaagaacuaaaccauucucugucccaauuuuaacuguugaggagaugaccaauucaagauuccccauuccuuuggaaaaguuguucacgggucccagcagugccuuuguuguucaaccacaaaacgguaggugcacgacugauggcgugcuccuagguacuacucaacuaucuccugucaacaucugcaccuucagaggggaugucacccauaucacagguagucauaacuacacaaugaauuuggcuucucaaaauuggaacaguuaugacccaacagaagaaaucccagccccucuaggaacuccagauuucguggggaagauccaaggugugcucacccaaaccacaagagcagauggcucgacccgcggccacagagcuacaguguacacugggagcgccgaauuugcuccaaagcuggguagaguucaauuugccacugacacagaaaaugauuuugauacuaaccaaaacacaaaguucaccccagucggugucauccaggaugguaauacuacccaccgaaaugaaccccaacaaugggugcucccaaguuacucaggcagaaauagucacaaugugcaucuggcccccgcuguagcccccacuuuuccgggugagcaacuucucuucuucagauccacuaugcccggaugcagcggguaccccaacuuggauuuggacugucuacucccccaggaaugggugcagcacuucuaccaagaggcagccccagcacaaucugauguggcucugcugagauuugugaauccagacacagguaggguuuuguuugaguguaagcuucauaaaucaggcuauguuacaguggcucacacuggccaacaugauuugguuaucccccccaaugguuauuucagauuugauuccugggucaaccaguucuacacacuugccccuaugggaaauggaacggggcguagacgugcauuauaa

SEQ ID NO: 6136 - RNA, 1626 nt, Artificial Sequence
  capsid_protein__Norovirus__AEA07712
augaggaugagugauggcgcagcgccaaaagccagcggcucugaagccagcggccaggaucuuguuccuuccgccguugaacaggccguccccauucagcccgugguuggugcgacucuugccgcccccgccgccgggcaaaucaaccaaauugaccccuggaucuuccaaaauuuuguccagugcccccuuggugaguuuuccauuucgccucgaaacaccccaggcgaaauauuguuugauuuggcccucgggccagggcucaaccccuaccuugcccaccucucggccauguacaccggcuggguugggaacauggagguucagcugguccucgccggcaaugccuuuacugcuggcaaggugguuguugcccuuguaccacccuauuuucccaaagggucaaucaccacugcucagaucacaugcuucccacaugucaugugugaugugcgcacccuggagcccauucaacucccucuucuugacgugcgucgaguucuuuggcaugcuacccaggaucaggaggaaucuaugcgccuggucugcaugcuguacacgccacuccgcacaaacagcccgggugaugagucuuuuguggucucuggucgccuucuuucuaagccggcggcugauuucaacuuuguguaccugaccccacccauugagagaaccaucuaucggaugguugacuugcccgugcuacagccgcggcugugcacgcacgcacguuggccagccccggucuauggccucuugguggacccaucccucccguccaacccccaauggcagaauggaagaguacauguugauggaacccuccuuggcacaacaccugucucuggguccuggguuuccugcuuugcagcugaagccgccuaugaguuccaguccggaauuggugagguggcaacguucacccuaauugagcaggacggguccgccuaccuccccggcgacagggcggccccccucggcuacccugauuucuccgggcagcuggagauugaagugcagacugagacaaccaaggcaggagacaaacugaaggugaccaccuuugagauggcucuuggccccaccaccaacguggaucaggcgccuuaccaggguagaguguuugccagcuucacggcuucagccucccucgaccugguggaugguagaguuagggcggucccacgcucuaucuuuggguuucaggacguggugccugaguacaaugauggucuccuuguuccccuugcccccccaauuggucccuuccuaccuggugagguccuccugagguuucgaaccuacaugcgucagaucgacuccucugaugcggcugcggaagccauugacugugcccuuccacaagaguucgucucgugguucgcgagcaacggauucacggugcagucggacgcucugcugcuuagguauaggaacacccucacagggcagcuguuguuugagugcaagcucuauagcgacgguuacaucgcccuauccuauucaggcucaggaccgcucaccuucccgacugauggcuucuuugaggucgucagcugggucccccgccucuaucaauuggccucugugggaagcuuggcaacaggccgaacacuuaagcaauaa

SEQ ID NO: 6137 - RNA, 1623 nt, Artificial Sequence
  capsid_protein__Norovirus__AEK05311
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucgcaguauccccuagaaacgcuccaggugaaauacuauggagcgcgcccuuaggcccugaucugaaucccuaccuaucucauuuggccagaauguauaaugguuaugcagguggguuugaagugcaggugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaucaaaacacaaaauucgccccagucggugucauccaggaugguagcaccacccaccgaaaugaaccccaacaaugggugcucccaaguuauucagguggaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguucgauuccuggguuaaucaauucuacacacuugcccccaugggaaauggaacggggcguagacgugcuuuauaa

SEQ ID NO: 6138 - RNA, 1608 nt, Artificial Sequence
  capsid_protein__Norovirus__AEP16505
augaagauggcgucgagugacgccgcuccaucuaaugauggugcagccggucucguaccagaggucaacaacgagacgauggcacuugagccgguggcuggggcuuccauagcugccccucuaaccggccaaaauaaugugauagaccccuggauuagaaugaacuuuguccaagcuccaaacggugaauucacaguguccccccguaauuccccaggugaaguguuguuaaauuuggaauuaggcccugaauuaaauccauuccuggcacaccuuucaagaauguacaaugguuaugcuggugggguugaagugcaggugcuacuugcugggaaugcguucacagcaggaaaacuaguguuugcagcaauccccccgcacuucccucuugagaaucugaguccuggucaaauuacaauguucccucaugugauuauugauguuagaacuuuagaaccuguccucuugccuuuaccagauguuagaaauaauuucuuucauuacaaucagcagccugaaccccguaugagacuuguggcuauguuguauacuccucuuagaucuaauggcucuggugaugauguguucacaguuucuuguaggguccucacucgccccucuccagauuuugauuucaauuauuugguccccccaacuguggagucuaaaaccaaaccauucacccugccaauauugaccauuggagaauugucaaauucuagguucccaguaccaauagaugaauuguacaccagccccaaugaaggagugguugugcaaccucaaaauggcagaucaacacucgauggugaacugcuuggcaccacacaacuuguaccaucaaacaucugugccuugcgagggcgcaucaacgcccaagugccagacgaucaccaucaauggaacuugcagguuacaaacgcaaaugggacuuccuuugaccccacugaagaugucccugcaccauugggcacgccggauuuccuggcaaacaucuacggaguuacuagucagagaaacccugacaacacuugccgugcccaugaugggguuuuggcaaccuggagcccuaaauuuacacccaaguuaggaucugugguuuuggguacuugggaagaaagugaucuugaucucaaucagccuacccgauuuacaccuguugguuuguaugauacaaaccacuuugaucaguggauucuacccaacuauucuggaagauugaccuuaaacaugaauuuggcgcccuccguugcuccccucuucccaggugaacaaauacucuucuuuaggucccacauaccacuuaaaggaggcacuuccaacggugccauugacugucuacucccucaggaauggauccagcauuuuuaucaggagucagccccgucccccacagauguggcucugauuagguaccccaacccugacacgggccguguccuuuuugaggcuaaacuacuuaggccgggauucauuacaguagcaaauuuugguuuuaaaccuauugugguccccccuaagggguauuuuagguuugauucuuggguuaaucaauuuuauucucucgcccccaugggaacugggaaugggcguagaagggugcaguaa

SEQ ID NO: 6139 - RNA, 1632 nt, Artificial Sequence
  capsid_protein__Norovirus__AEY77318
augaugauggcgucuaaggacgccccaacaaacauggauggcaccaguggugccggucagcugguuccagagguuagcacagcugaaccuauaucaauggaaccuguggcuggugcugccacagcagcagcaaccgcaggucaaguuaauaugauugaccccuggauuaugaguaauuauguucaagccccucaaggagaguucacaauuuccccuaacaauacccccggagacauauuguuugauuuacaauuaggcccccauuuaaacccauuccuaucacaccuggcccagauguacaauggguggguuggcaauaugaaaguuagggugcugcucgcugguaaugcauuuacagcgggcaaaauaauaaucaguuguguccccccagguuuugcagcccagaauguuucaauagcccaagcuacuauguucccccauguuauugcagaugugcgagugcuugaaccaauugaagucccacuagaggaugugaggaaugugcuuuuccauaauaaugauucuaccccaacuaugagauugauuuguauguuguauaccccucuccgugcuagugguaguucuucuggcacugauccauuuguuauagcuggucggguccucaccugucccaguccugacuuuaacuuuuuguuccuuguccccccuaauguugaacagaaaaccaagccauuuagugugcccaaucucccccuuaauguucucucaaacucuaggguucccucucugauaaaguccaugauggucucccaagaccauggacagaugguacaauuccaaaaugguaggguuacauuagauggacagcuccaagguaccacccccacuucagcuagucagcucugcaaaauucgagggacgguuuaccaugcaacugguggucaagggcuuaauuuaacugaaauugaugggacccccuaccaugcauuugaaagcccugccccaauuggcuuccccgauuuaggugagugugauuggcacauuaacgcaucuccugcuaaugcuuucacagaugguaguauuauacauagaauugauguagcucaggauucuacuuuugccccccaucuaggcacuauccauuauacuaaugcugauuauaaugcuaauguuggccugauuuguucacuugaauggcuuuccccaccaagugguggugcuccaaagguaaauccgugggcuauuccucgguaugguucaacucugacugaggccgcccaacuggccccaccaauauacccccccgguuuuggugaggcaauuguuuucuuuaugucugauuuccccauagcuaaugguucagauggucugaguguucccugcacuauaccacaagaguuugugacccacuuuguuaaugaacaagcaccaacccguggggaagcugcccuccuucauuauguugacccugacacacaccgcaaucuaggugaguuuaaacuauacccugaaggauucaugaccuguguaccaaauucuagugguaguggcccccaaacacugcccaucaauggggucuucacuuucaucucuuggguuucccguuucuaucaacuaaagccugugggaacgaccggaccgguucguaggcucggaauuaggagaucauaa

SEQ ID NO: 6140 - RNA, 1626 nt, Artificial Sequence
  capsid_protein__Norovirus__AEY83583
augaggaugagugauggcgcagcgccaaaagccaacggcucugaagccagcggccaagaucuuguuccuaccgccguugaacaggccguccccauucagcccguggcuggugcggcucuugccgcccccgccgccgggcaaaucaaccaaauugaccccuggaucuuccaaaauuuuguccaaugcccccuuggugaguuuuccauuucgccucgaaacaccccaggugaaauacucuuugauuuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuccccaaagggucacucaccaccgcccagaucacaugcuucccacacgucaugugugaugugcguacccuggagcccauucaauugccucuucuugacgugcgucgaguucuuuggcaugcuacccaggaucaggaggaaucuaugcgccuggucugcaugcuguacacgccacuccgcacaaacagcccgggugaugagucuuuuguggucucuggccgccuucuuucuaagccggcaccugauuucaacuuuguauaccugacccccccuaucgagagaacuauuuaccggaugguugacuugcccguguugcagccgcggcugugcacgcacgcucguuggccggccccggucuauggccucuugguagacccaucccucccauccaauccccaguggcagaaugguagagugcaaguugaugggacucuucuugguacaacgccugugucugguucauggguuuccugcuuugcagcugaggcugccuacgaguuccaagcugggacuggugagguggugaccuucaccaugauugagcaggacggauccgccuauguccccggugacagggcggccccccuuggguaccccgacuucucugggcaacuggagaucgaggugcagacugagaccaccaaaacaggcgacaagcucagggugaccaccuucgagaugauccuuggccccaccaccaacguggaccaggcccccuaccagggcagagcguacgcgagcuuaacagcugcagccucgcuugaccugguggaugggagaguuagggcggucccacgcuccaucuauucuuuccaggaugagcucccagaguauaaugaugguguuuugguuccccuugccccaccccuaggccccuuucuuccuggugagguuuuguugagguuucguaccuacaugcgccagcuugacaccgcugacgccgcagcgcagccgaucgacugugccuugccccaggaguuuaucuccugguuugcaagcaacaacuucacgguccagucggacgcgcuccugguuagguaccggaauaccuugacuggccagcuccuguuugaggcuaagcuuuauagugaaggcuacauugcugugucuuacucagggucuggcccccucacuuuccccacugacggcuucuuugagguugucagcugggucccccgccucuuucaauuggccuccgugggaagcuugguaacaggccgaacacucaaacaauaa

SEQ ID NO: 6141 - RNA, 1629 nt, Artificial Sequence
  capsid_protein__Norovirus__AFB18010
augaagauggcgucgaaugacgccgcuccaucuacugauggugcagccggccucgugccagaaaguaauaaugaggucauggcucuugagccaguggcuggcgcugccuuggcggcuccagucacuggccaaacaaauauuauagacccuuggauuagaacaaauuuuguccaggccccuaauggugaauucacuguuucuccacgcaacgccccuggugaagugcuguuaaaucuagaguuggguccagaauuaaauccuuaucuggcacauuuggcaagaauguacaacggguaugccggcggaauggaggugcaggucauguuagcuggaaaugcguuuacagcuggaaaguuggucuucgccgcagucccaccucauuuucccguugaaaaucuuagcccacagcaaaucacaauguuuccccaugugauuauugauguuaggacuuuggaaccuguccuguuaccacucccugauguuagaaauaauuucuuucauuacaaucaaaaggaugacccuaagaugagaauuguggcuaugcucuauacuccccucagaucaaaugguucuggugaugauguauucacaguuucuuguagaguguuaacuaggcccuccccugacuuugauuuuacguauuuggugccaccaacgguggaauucaaaacaaagccauucacacucccaauccuuacauuaggggagauguccaauucaagauucccagugcccauagaucaaauguacacuagcccuaaugaaauuauuucugugcagugucagaauggcaggugcacacuggacggggagcuccaagggacaacacagcuccaggucagugguauuugcgcauucaaaggacaagugaccgcccaccuacaggacaaugaacaucuuuacaaugucaccaucacaaauuugaauggguccccuuuugaccccucugaggacauccccgcuccccuggguguucccgacuuugaagggaggguuuucggugucaucagccaaagagauaauuacaauucugguggacaaaaccagccugcaaauaggucucaugaugcuguggucccaacuuacacagcucaauauacuccaaaauugggucaaauucaaauuggcacguggcagacugaugauauaacagucgaccagccugcuaaauucaccccaguuggccuuagugacacagaccacucuaaccaaugggugguuccuagguaugcuggugcauuaaauuugaacacaaaucuugccccuuccguugcaccgguguucccaggagagcgguugcuuuucuuuagaucauacaucccccuuaaaggugguuuuggcaacccagccauugauugccuggugccacaggaguggauacagcacuucuaccaagaagcugcucccucacugagugaggucgcccuugccagguauaucaauccggacacuggucgggcacuguuugaggccaagcuccacagggcuggcuucaugacagucucgaguaacaccagugccccggugguuguaccugccaauggguacuucagauuugauucuugggugaaccaauuuuauucucuugcccccaugggaacuggcaaugggcguagaaggauucaauaa

SEQ ID NO: 6142 - RNA, 1623 nt, Artificial Sequence
  capsid_protein__Norovirus__AFB18013
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggccccgaucugaaucccuaccuuucucauuuggccagaauguacaauggcuaugcagguggcuuugaagugcagguaauccuugcggggaaugcguucaccgccgggaaagucauauuugcagcagucccaccaaauuucccaacugaaggcuugagccccagccaggucacuauguucccccauauaguaguagauguuaggcaacuggaaccuguguugauccccuuaccugauguuaggaacaauuucuaucacuacaaccaaucaaaugaccccaccauuaaacugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggucacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguacccuaacaugaauuuggauugccuacucccccaagaaugggugcagcacuucuaccaagaggcagccccagcacaaucugauguggcucugcuaagauuugugaauccagacacagguaggguucuauuugagugcaagcuucauaaaucaggcuaugucacaguggcucacacuggccagcaugauuuggucaucccccccaauggcuacuuuagauuugauuccugggucaaccaauucuacacacuugcccccaugggaaaugggacggggcguagacgugcauuauaa

SEQ ID NO: 6143 - RNA, 1743 nt, Artificial Sequence
  capsid_protein__Norovirus__AFJ05624
augaagauggcgucuaaugacgccacggcuccaucucaggauggggcggccaaccucgucccagagagucagcaugagguuuuggccuuggaaccaguugccggggcagcacuugccgcccccguggcuggacaauuuaaugccauugaccccuggauuaagcaaaauuuuguccaagccccagccggggaguuuacggugucaccacguaaugccccuggagaaauccuuauggaucucgagcuuggcccugaauugaaccccuuucuggcacaccuugcacagauguacaacgccuaugcuggagggauggaagugcagauaauccuugcggggaacgcguucacugcagguaagauaauagucugugcuguaccaccaaauuuuccaccagaucggcugucugccucccaggccacaaacuucccacaugucaucauggacgucaggacguuagagccagugauccuccccuugccugacguucgcgcuggcuucuuccacuauaaccagcugagagagccgcgcaugcgacucauggcccuccuuuacacaccucugagagccaaugggacuggagacgaugccuucaccguuucgugcagggugcucacgcgcccuaugcaggauuuugaguucauguuccucgucccaccaaccgucgagucucgugucaccccuuuuucagugccaaccuaccccgugguggagaugacaaacuccagauggccagccaggauuucaggcaugcaugucaacgcaaaccaaacccuggcuguccaauuucagaauggcaggugcacccuggauggccaacucauggggaccacgcagcucugugccgccgaugucugcaggaugaggggucgauacacuuccaccagagccgaccuugcaggaguugaccacaccgaccaggguccgucccugggaacuggaccuucagaugauuccgucaguguuccggaggcgcgggcucagaccaggacuggugucagugcacaccuacagcuugaggagcugaauggccaacccuaugaagucuauggagagcaaccagcaccacuugggaccccagacuuucgcuguaggcugaugggagagcuugucagauugccauccaccagcccggcagcccagucgagauuccgugacgccuucuuugacaccuauggcgcgcucuucgccccagcggugggcuccacgaccuuuacggucaacaacagcuccaccucagacuuugccaauggccaacccuucgaguucuugccaauuggaguugagaucggaaacucugcucaguaugaugaguuugcgcugcccagcuacaacggggccauaggggagaaucgccaccucgccccugucgcggccccgggguuucccggugaaaacauagucuuuuucuccuccaaucuuccagugugggauuccaccuccgcgcagaacaacaggaggaucucaugccuguugcccaaugaguuuguccagcacuucuaugaccuccaggcaccgucccaauccgacguggcccuucugagguauguccacccugagucuggucgaguucuauuugagugcaagcuguacagagaugguuuucuuacugucaauggggcaagccucgcagaauucccagucaacggguacuucagguuugacucaugggugaaccaauucuucacacucagcccugugggaacuggcuccggccguagggggcgcucucgcaacgcccaauaa

SEQ ID NO: 6144 - RNA, 1746 nt, Artificial Sequence
  capsid_protein__Norovirus__AFJ05628
augaagauggcgucuaaugacgcugcauccccaucuucggauggggcagccaaccucguaccagagaucaacaaugagguuauggcuuuagaaccaguggccggcgcacaauuggcagccccugucgccggccaguucaaugcaauugaucccuggauaagacaaaauuuuguucaagcaccugaaggugaauucacaguuucuccucggaaugccccgggugagauucuguugaaucuggaauuggguccacaccucaaucccuuccugcaacauuuggcucagauguauaaugcauaugcaggcggcauggaagugcaggucguccuugcggggaaugcguucaccgccgggaagaucaucuuugccgcugucccuccacacuucccgccugagagacuuucugcggcgcaagccacccaguucccccaugugauaguugauguuaggcagcuugagcccauaauccugccccuccccgaugucagacauaauuuguuccauuucaaucagcaaaaugaugagaggaugcaucugguugccuuucuguacacaccccuacgugccaacucugggaguggugaugauguguuuacagugucaugucgggucuugacccgaccgucucaggacuuugaguucauguuccugguuccccccacggucgagaagaaaacaguggcguucucgcucccucaauuggcuaucggggaaaugucaaauucuagguggccugcccgcaucacaggcuuggucgucgacccucgacucccccaaguccugcacauccagaaugggcggugcacuuuagaugggacacucaugggcaccacacagcucaaccccaaugacauuugcaggauucggggcuacuucuccagcucaaggcccgaacugcuaugugagaaugaagaaagugcaacugauccaaugcccaccgagacugauacagacaaccagccaccagaggugagagcccaagcgcgugcgacucagcgaugguuugccgugacggagcucaauggacaaguuuaugacccuuucggugaucaacccgcaccgcuugggguuccugacuucaaggcacgcauacuuggugcauugaugcgacugccugggacuaauccaacauccaauucaagguuugaggaugcauggguggagaccaacaaucagaccaccuacgcacccgcggccgguguggucgccaucaccaccaaugauaauagcuccuccaacuaugccaaugaccagacaugcgaguuugugccacuaggcauugagaucacggacucagcccccuaccaugaguucgaucuacccaguuaugguggugcagccuccucagguaaccgcaaucuggcccccacgguugcccccacauucccaggugaggccauccuucuuuuuggcucaaauaugccagucuacaacaggaauacaggcaccagcaacaaggacauacggugucucuugcccaaugaguaugugcaacaccucuaugacacacaagcuccuagucuaagcgauguugcccucgucagguacgucaaccgcgacacuggacgcguccuguuugaggccaagcugcaccgcgacgguuucaugacagugaaugcgucuucuacaacgguccuaccuguagacggguauuuccgcuuugacucuugggucaaccaguucuaugcacucagccccgugggaaacgccucuggcaggcgagggcgcagcaggcagaccaauuaa

SEQ ID NO: 6145 - RNA, 1623 nt, Artificial Sequence
  capsid_protein__Norovirus__AFJ24945
augaagauggcgucgaaugacgccaacccaucugauggguccgcagccagccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaaguacaggugauccucgcggggaacgcguuuaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguggaaauguccauaauguacaccuagccccugcuguagcccccacuuuuccgggugaacaacuucuuuucuuuagguccacuaugcccgggugcagcggguauccaaacauggauuuggauugccuacucccccaggagugggugcagcauuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6146 - RNA, 1638 nt, Artificial Sequence
  capsid_protein__Norovirus__AFK75851
augaugauggcgucuaaggacgccccaccaaacauggauggcaccaguggugccggccagcugguaccagaggcaaauacagcugagccuauaucaauggagccuguggcuggggcagcaacagcugccgcgaccgcuggccaaguuaauaugauugaccccuggauaaugaauaauuaugugcaagccccucaaggugaauuuacuauaucgcccaauaacacaccaggugauauuuuguuugaccuacaauuaggcccccaucucaauccuuucuuaucccauuuggcccaaauguauaaugguuggguuggcaauaugaaagugaagguccuauuggcugguaaugccuucacggcuggcaaaauaauuauuaguugcauacccccuggcuuugcugcacaaaacaucuccauugcucaagcuacaauguuuccccacgucauagcugauguuaggguucuagaaccuauugaagugccacuggaagaugugagaaaugugcuguuccauaacaaugacaacacaccaaccaugagguuggugugcaugcucuacacccccuugcgagccaguggcagcucaucugggacugacccuuuugugauugcugggcguguauuaacaugcccaagcccugauuuuagcuuuuuauucuuggucccccccaauguagaacaaaagacuaaaccauuuagugucccaaaucuuccauugaacacccuuucaaauucaagagucccuucucuaauuaggucaaugaugguguccagagaccaugggcagaugguucaguuucaaaaugguagggucacccuagaugggcaacugcaaggcaccacacccacaucagcuagccaacugugcaaaaucagaggcagugucuuccacgcuaauggugggaauggguauaacuuaacugaacuggaugggagcccauaccaugcauuugagagcccugcgccaauaggguuuccagacuugggugagugugauuggcacauggaggccuccccuaccacccaauucgauacuggugauguuauaaagcaaauuaaugucaaacaagaagcagcauuugcuccccaccuugguacuauacaagcagacggccugagugaugugagugucaacacuaacaugauagcuaaauuaggaugggugucacccgucagugauggacauagagggagugucgauccgugggucauuccacgauacgggucgacuuugacugaggccgcccaacuagccccuccaauauaucccccagguuuuggugaggccauuguguuuuucaugucagauuuuccuauugcccauggugcaaauggcuugagugugccuugcaccauaccccaagaauuugucacucauuuugucaaugaacaggccccuacuagaggggaagcagcccuacugcauuauuuagauccugacacccauagaaaucuaggugaguucaaacuauauccugagggcuucaugacgugugugccuaacuccaguggcacugguccacaaacccucccaaucaaugguguuuuugcuuuuguguccuggguuuccagauucuaucaguuaaagccugugggaacagccggcccggcucguaggcuugggauuaggagaucauaa

SEQ ID NO: 6147 - RNA, 1635 nt, Artificial Sequence
  capsid_protein__Norovirus__AFK75852
augaugauggcgucuaaggacgcuacaccaagcgcagauggcgccacuggcgccggccagcugguaccggagguuaauacagcugacccuauacccauugacccuguggcuggcuccucuacagcacuugccacugcaggccagguuaauuugauugaucccuggauaaucaauaauuuugugcaagccccccagggugaauucacaauauccccaaauaauacccccggugaugugcuuuuugauuugcaguuaggaccucauuuaaacccuuuccucucccaucucucucagauguauaauggcugggugggcaacaugcgaguucguguugucuuggcugguaaugcuuuuacggcugggaagguuauaauuuguuguguccccccugguuuucaaucucgcacucuuuccauagcucaggccacuuuauuuccccacgucauugcugauguuaggacccuugacccuguagaagugccucuugaagaugucaggaauguguuguaucauaauaaugacacccaaccuaccaugcgccuccuuugcauguuguacacuccucuccgcaccgggggagcguccggugggacugauucuuucgugguagcugggcgugugcuuacuugcccaggcccugacuuuaacuucuuauucuuagucccuccuacagucgagcaaaagacucgcccuuucacugugccuaauaucccuuugaaguaucugucuaacuccagaaucccaaaccccauugaagguaugucauugucaccugaccagacucaaaauguccaauuccagaauggcaggugcacaauugacggucaaccccucgggaccacaccugucucgguuagccaguuauguaaguuuagggguaggauuacaucuggacagaaggugcucaauuugacagaguuggaugguucaccuuuuauggccuuugcugccccugccccugcgggcuucccagaucuuggguccugugauuggcauauugagaugaguaaaaucccaaauucuagcacccagaguaauccaauaguggucaauucuguuaagcccaauagucaacaguuugucccacacuugucaagcaucacccuugaugauaauguuucuagugggggugauuauauugguacuauacaauggaccucuccuccuucugauucuggcggagccaauacaaacuuuuggaaaaucccugacuaugggucuagccuggcugaagcuucacagcuggcccccgcugucuauccaccugguuuuaaugaggugauuguguauuuuauggcaucuauaccuggccccaaucaaucugggucccccaacuuggugccaugccuacucccccaggaauauauaacacauuucauuagugagcaggcccccauucagggugaggcugccuuacuccauuauguggacccagacaccaaucguaauuugggugaguuuaaauuguauccuggugguuauuuaaccuguguuccuaauaguucuaguacuggaccucagcagcuuccucuugaugguguauuugucuuugcuucuuggguuucuagauuuuaucaauuaaagccugugggaacagccggaccggcuagagguaggcuugguguccgcagauaa

SEQ ID NO: 6148 - RNA, 1641 nt, Artificial Sequence
  capsid_protein__Norovirus__AFK75853
augaugauggcgucuaaggacgccucucaaagcgcugauggcgcaagcggcgcaggucaacuggugccggagguuaauacagcugaccccuuacccauggaacccguggcugggccaacaacagccguagccacugcugggcaaguuaauaugauugaucccuggauuguuaauaauuuuguccagucaccacaaggugaguuuacaauuuccccuaauaauacccccggugauauuuuguuugauuuacaauuagguccacaucuaaacccuuucuugucacauuugucccaaauguauaauggcuggguuggaaacaugagaguuaggauucuccuugcugggaaugcauuuucagccggaaagauuauaguuuguuguguccccccuggcuucacaucuuccucucucaccauagcucaggcuacauuguuuccccaugugauugcugaugugagaacccuugaaccaauagaaaugccucucgaggauguacgcaauguccucuaucacaccaaugauaaucaaccaacuaugcgguugguguguaugcuguacacgccgcuccgcacugguggugggucugguaauucugauucuuuugugguugcuggcagggugcucacggccccuaguagcgacuucaguuucuuguuccuugucccgccuaccauagaacagaagacucgggcuuuuacugugccuaauauccccuugcaaaccuuguccaauucuagguuuccuucccucauucaggggaugauucuguccccugacgcaucucaagugguccaauuccaaaauggacguugucuuauagauggucaacuccuaggcacuacacccgccacaucaggacaguuguucaggguaagaggaaagauaaaucagggagcccgcacacucaaccucacagagguggauggcaaaccauucauggcauuugauuccccugcaccugugggguuccccgauuuuggaaaaugugauuggcacaugagaaucagcaaaaccccaaauaacacaagcucaggugacccuaugcgcagugucagcgugcaaaccaaugugcaggguuuugugccacaccuggggaguauacaguuugaugaaguguucaaccaccccacaggugacuacauuggcaccauugaauggauuucccagccaucuacacccccuggaacagauaucaaucugugggagauccccgauuauggaucaucccuuucccaagcagcuaaucuggcccccccaguauuccccccuggauuuggugaggcucuuguguacuuuguuucugcuuuuccaggccccaacaaccgcucagccccgaaugaugugccaugucuccucccucaagaguacauaacccacuuugucagugaacaagccccaacgaugggugacgcagcuuugcugcauuaugucgacccugauaccaacagaaaccuuggggaguucaaguuauacccuggagguuaccucaccuguguaccaaacggggugggugccgggccucaacagcuuccccuuaauggugucuuucucuuugucucuugggugucucguuuuuaucagcucaagccugugggaacagccaguacggcaagagguaggcuuggagugcgccguauauaa

SEQ ID NO: 6149 - RNA, 1647 nt, Artificial Sequence
  capsid_protein__Norovirus__AFK75854
augaagauggcgucgaaugacgcugcuccaucuaaugauggugccgccggccucgucccagagaucaacaaugaggcaauggcgcuagauccaguggcgggugcagcgauagcagcgccccucacuggccagcaaaauauaauugaucccuggauuaugaauaauuuugugcaagcaccugguggugaguuuacagugucaccuaggaauuccccuggugaagugcuucuuaauuuggaauuagguccagaaauaaaccccuauuuggcucaucuugcuagaauguacaaugguuaugcagguggauuugaagugcaagugguccuagcuggaaaugcguuuacagcaggaaagguuaucuuugcagcuauacccccuaauuucccuauugacaaucugagcgcggcacagaucacaaugugcccgcacgugauuguggaugucaggcaguuggaaccaaucaaucucccaaugccugauguccgcaacacuuucuuucauuauaaucaagauucugauucaagauugcguuugauugcaauguuguauacaccucuuagggcaaauaauucuggagaugauguuuucacugugucuuguaggguguuaacuaggcccagcccugauuucucauucaauuuucuugucccaccuacuguggaaucaaagacaaagcuuuuuacccuccccauuuuaaccaucucugaaauguccaauuccagguuuccaguuccaauugacucuuugcacaccagcccaacugagaauauaguaguccagugccaaaaugggcgcgucacucuugacggugaguuaaugggcaccacccaacuccuaccaagccaaauaugugcuuucaggggcacacucacuagaucaacaagcagggccagcgaccaagccgacacaccaacccccaggcuauucaaccaucguuggcacauacaauuggacaaucuaaauggaacucccuacgacccugcagaggacauaccagcuccuuugggcacaccagacuuccggggcaaggucuuuggcguggccagccagagaaaccccgacagcacaacaagggcacaugaagcaaaaguggacacaacaucuggccgcuucaccccaaaauuaggcuccuuagaaauaaccacugagucugaugacuuugacacaaaccagucaacaaaauucaccccaguuggcaucgggguugacaaugaggcagaauuucaacaaugguccuuacccaacuauucuggucaguuuacucauaauaugaacuuagccccagcugucgcccccaauuuuccuggugaacagcuacuuuucuuccgaucacagcugccauccucugguggguggucuaacgggguucuagacugccuggucccccaggaauggguucaacacuuuuaccaagaaucagcccccgcccaaacgcagguggcccugguuagguaugucaacccugacacugguagaguguuauuugaggcuaagcuacacaaauuggguuuuaugacuauagcaaagaauggugacuccccaauaacugucccuccaaauggauacuuuagauuugaaucuuggguuaaccccuucuacacacuugcccccaugggaacuggaaacgggcguagaaggauucaauaa

SEQ ID NO: 6150 - RNA, 1671 nt, Artificial Sequence
  capsid_protein__Norovirus__AFN61315
augaagauggcgucgagugacgcugcuccaucugcggauggugcgggcaaccucguuccagagagucaacaagagguguugccccucgccccaguugcaggcgcugcgcuagcggcaccugugguggggcaaacaaauauaauugaccccuggauuaaagaaaauuuuguucaagccccccagggugaguucacugucucaccuaaaaauucuccuggcgaaauuuugguuaauuuggaauugggacccaaacucaaccccuaucuagaccaccucucacgcauguacaauucauaugcugguggcauagaugucauggugguguuggcgggcaacgccuucacagccggcaagguuuugauagcagcuauccccccaaauuucccaguugaaggaguguccgcuucacaggccacucaauucccccaugugaucauagauguuaggacacuugacccuguucggcuuccccucccggaugugcgaucuacauucuuccacuacacuaaugauacugaaccaaaaaugagguuaguuauuuggcuuuacaccccacuuagaacuaauggcaguggugaugauucuuucaccgucucugggcgcauacucacaaggcccucccaggacuuugaauuugcuuuucuuauccccccaacaguggaaacaaagacaacccccuucucagugccgggcuucucggugcaggaaauguccaacucaagguggccagcugccaucucugcaauggucguccgugggaaugagccccaaguuguucaguuccagaauggcagggcccaccuagaugguaugcugcuugguacgacaccugugucgcccaauuacauagcauccuaccgaggcauuuccacuggcaacucucguucugcuuccucugaggccgacgagagggcuguugguagcuuugauguguggauccgcuuacaagaaccugauggccagcccuaugacaucuuugguaagcagccagccccaauuggcaccccugauuucaaggccgugauaguuggcuuugcagcuaggccccucacauccggguccuacgcaaaugaagcguaugucaacaccacagccagugacuacgccccagccacugguaauaugcgcuucacagucaggaacggcgggaccgggcacauaucugcaaacaaauacugggaguucagaucauuugguguugaaggagaaaggcacacugauguccaguaccaggaguaugagcuucccgauuauucuggucaaguugcuuccaaccauaauuuggcccccccuguggccccacgcaugcccggugagucauuauugcuuuuccaaucaaauaugccugugugggaugaugggcgcggagaguccacacccaagaagauucauugccuacugccacaggaguucauuggucauuucuuugauaagcaagccccuucccuaggugaugcugcacuacuuagguaugucaaccaggagacaaauagaguguuguuugaguguaaacuuuauagggaugguuacaucacaguugcugcagcaucaggauuacuagacuucccuuuggauggauucuuuagguuugauucuuggguuaguucuuuuuacauuuuaucccccgugggaagcggccaaggccgcagggguagagugagguuucaauaa

SEQ ID NO: 6151 - RNA, 1623 nt, Artificial Sequence
  capsid_protein__Norovirus__AFQ00511
augaagauggcgucgaaugacgccaacccaucugaugggucagcagccaaccucgucccagaggucaacaaugagguuauggcuuuggaacccguugucggugccgcuauugcggcgccuguagcgggccaacaaaauguaauugaccccuggauuagaaauaauuuuguacaagccccugguggagaguucacaguauccccuagaaacgcuccgggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauucacuguuccaaucuuaacuguugaagaaaugaccaauucaagauuccccauucccuuggaaaaauuguucacgggucccagcagugccuuuguuguucaaccacaaaauggcagaugcacgacugauggcgugcucuuagguaccacccaacugucuccugucaacaucugcaccuucagaggggaugucacccacauugcagguucucgcaauuacacaaugaauuuggcuucucuaaauuggaacaauuaugacccaacagaagaaauuccagccccucuaggaacuccagacuucgugggaaagauccaaggugugcucacucaaaccacaaagggagauggcucgacccguggccauaaagcuacaguuuacacugggagugccccauuuacuccaaagcugggcaguguucaauucaguacugauacagaaaaugauuuugaaacucaccaaaacacaaaauucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaccaauucuacacacuugcccccaugggaaauggaacggggcguagacguguuuuauaa

SEQ ID NO: 6152 - RNA, 1623 nt, Artificial Sequence
  capsid_protein__Norovirus__AFQ00512
augaagauggcgucgaaugacgccaacccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccgggugaaauacuauggagcgcgcccuuaggcccugaucugaaucccuaccuaucucauuuggccagaauguauaaugguuaugcaggcgguuuugaagugcaggugauccucgcggggaacgcguucaccgccggaaaaaucauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaauugauagcaaugcuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacucaacugucuccugucaacaucugcaccuucagaggggaugucacccacauugcagguucucguaauuacacaaugaauuuggcuucucuaaauuggaacaauuaugacccaacagaagaaauuccagccccuuuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6153 - RNA, 1623 nt, Artificial Sequence
  capsid_protein__Norovirus__AFQ00513
augaagauggcgucgaaugacgccaacccaucugauggguccgcagccaaccucgucccagaggucaacaaugagguuauggcuuuggagcccguugucggugccgcuauugcggcgccuguagcgggccagcaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcuggaaaaauuauauuugcagcagucccaccaaauuucccaacugaaggcuugagucccagccaggucacuauguucccucacauaauaguggauguuaggcaguuggaaccuguguugauccccuuaccugauguuaggaauaacuucuaucacuacaaucagucaaaugauucuaccauuaaauugauagcaaugcuauauacaccacuuagggcuaacaaugcuggggaugaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcagugccuucguuguucaaccacaaaauggcagaugcacgacugauggcgugcucuuaggcaccacccaauugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaaggugugcucacucaaaccacaaagggagaugguucgacccguggccauaaagccacaguuuacacugggagugcccccuuuacuccaaagcuggguaguguucaguucaguacagauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguauccuaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuacgucacaguggcucacaccggucagcaugauuuggucaucccccccaaugguuauuuuagguuugauuccuggguaaaucaauucuacacacuugcccccaugggaaauggaacggggcgcagacgugcuuuauaa

SEQ ID NO: 6154 - RNA, 1623 nt, Artificial Sequence
  capsid_protein__Norovirus__AFQ00516
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuugccugauguuaggaauaacuucuaucacuauaaucagucaaaugauuccaccauuaaauugauagcaauguuguauacaccacuuagggcuaauaaugcuggggaagaugucuuuacagucucuugucggguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaacuacaaagggagauggcucgacccguggccauaaagcuacaguuuacacugggagcgccccauuuacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuuguaaauccagacacggguaggguccuguuugagugcaaacuucacaaaucaggcuaugucacaguggcucacaccggccagcacgauuuggucaucccccccaauggcuauuuuagguuugauuccuggguuaaucaguucuacacacuugcccccaugggaaauggaacggggcguaggcgugcuuuauaa

SEQ ID NO: 6155 - RNA, 1623 nt, Artificial Sequence
  capsid_protein__Norovirus__AFQ00517
augaagauggcgucgaaugacgccaacccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggagguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaauugauagcaaugcuguauacaccacuuagggccaauaaugcuggggaagaugucuuuacagucucuugucgaguucucacgaggccauccccugauuuugauuucauauucuuagugccaccuacaguugagucaagaacuaaaccauuuacugucccaaucuuaacuguugaagaaaugaccaauucaagauuccccauuccuuuggagaaauuguucacgggucccagcagugccuuuguuguucaaccacaaaauggcagaugcacgacugauggcgugcucuuaggcaccacccaacugucuccugucaacauuugcaccuucagaggggaugucacccacauugcagguucucguaauuacacaaugaauuuggcuucucuaaauuggaacaauuaugacccaacagaagaaauuccagccccucuagggacuccagacuucgugggaaagauccaaggugugcucacucaaaccacaaagggagauggcucgacccguggccauaaagcuacaguuuacacugggagugcccccuuuacuccaaagcuggguaguguucaauucaguacugauacagagaaugauuuugaaacucaccaaaacacaaaguucaccccagucggugucauccaggaugguggcaccacccaccgaaaugaaccccaacaaugggugcucccaaguuauucagguaggaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6156 - RNA, 1623 nt, Artificial Sequence
  capsid_protein__Norovirus__AFQ00518
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaacaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuuuauauuuuugguaccaccuacaguugagucaagaacuaaaccauuuacugucccaaucuuaacuguugaggaaaugaccaauucaagauuccccauuccuuuggaaaaguuguucacgggucccagcagugccuuuguuguucaaccacaaaauggcagaugcacgaccgauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugagacucaccaaaacacaaaauucaccccagucggugucauccaggaugguggcaccacccaccgaaaugaaccccaacaaugggugcucccaaguuauucagguagagaugucccuaauguacaccuagcccccgcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6157 - RNA, 1623 nt, Artificial Sequence
  capsid_protein__Norovirus__AFQ00519
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguggauguuaggcaauuggaaccuguguugauccccuuaccugauguuaggaauaauuucuaucacuauaaucagucaaaugauucuacuauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaauucaagauuccccauuccuuuggagaaguuguucacgggucccagcagugccuuuguuguucaaccacaaaauggcagaugcacaacugauggcgugcucuuaggcaccacccagcuguccccugucaacaucugcaccuucagaggggaugucacccacauugcagguucucgaaauuacacaaugaauuuggcuucucuaaauuggaacaauuaugacccaacagaagaaauuccagccccucuaggaacuccagauuucgugggaaagauccaaggugugcucacucaaaccacaaggggagauggcucgacccguggccauaaagccacaguuuacacugggagugcccccuucacuccaaagaugggcaguguccaauucaguacugacacagaaaaugauuuugaaacucaccaaaacacaaaauucaccccagucggugucauccaggaugguggcaccacccaccgaaacgaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacgugcuuuauaa

SEQ ID NO: 6158 - RNA, 1623 nt, Artificial Sequence
  capsid_protein__Norovirus__AFQ00520
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagcuccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccuuuaccugauguuaggaauaacuucuaucacuauaaucagucaaaugauucuaccauuaaauugauagcaaugcuguauacaccacuuagggcuaauaaugcuggggaagauguuuucacagucucuugucgaguucucacgagaccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccggauuucgugggaaagauccaagguaugcucacccaaaccacaaagggagaugguucgacccguggccauaaagcuacaguuuacacugggagugcccccuuuaccccaaagcugggcaguguucaauucaguacugauacagaaaaugauuuugaaacucaccaaaacacaaaauucaccccaguuggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggacugccuacucccucaggagugggugcagcacuucuaccaagaggcagcuccagcacaaucugauguggcccuauugagauucgugaauccagacacggguaggguccuguuugaguguaaacuucauaaaccaggcuaugucacaguggcucacaccggccagcaugauuugguuaucccccccaaugguuauuuuagguuugauuccuggguuaaucaauucuacacacuugcccccaugggaaauggaacggggcguagacgugccuuauaa

SEQ ID NO: 6159 - RNA, 1623 nt, Artificial Sequence
  capsid_protein__Norovirus__AFQ00521
augaagauggcgucgaaugacgccaacccaucugauggguccgcggccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaacuucuaucacuauaaucagucaaaugauuccaccauuaaauugauagcaaugcuguauacaccacuuagggcuaauaaugcuggggaagaugucuucacggucucuugucgaguucucacgaggccauccccugacuuugauuuuauauuuuuggugccaccuacaguugagucaagaacuaaaccauucacugucccaauccuaacuguugaagaaaugaccaauucaagguuucccauuccuuuggaaaaauuguucacuggucccagcagugccuuuguuguccaaccacaaaauggcagaugcacgacugauggcgugcucuuaggcaccacccaacugucuccugucaacaucugcaccuucaggggggaugucacccacauugcagguucucguaauuacacaaugaauuuggcuucucuaaauuggaacaauuaugacccaacagaagaaauuccagccccucuaggaacuccagauuucgugggaaagauccaaggugugcuuacccaaaccacaaagggagaugguucgacucguggccauaaagcuacaguuuacacugggagugcccccuuuacuccaaaguugggcaguguucaguucagcacugauacagaaaaugauuuugaaacccaccaaaacacaaaauucaccccagucggugucauccaggaugguggcaccacccaccgaaaugaaccccaacaaugggugcucccaagcuauucagguagaaauguccaaaauguacaccuagccccugcuguagcccccacuuuuccgggugaacaacuucuuuucuuuagguccacuaugcccggaugcagcggguaucccaacauggauuuggauugccuacucccucaggagugggugcagcacuucuaccaagaggcagccccagcacaaucugauguggcucuauugagauuugugaauccagacacggguaggguccuguuugagugcaaacuucauaaaucaggcuaugucacaguggcucacaccggccagcaugauuuggucaucccucccaaugguuauuuuagguuugauuccugggucaaucaauucuacacacuugcccccaugggaaauggaacggggcguagacguguuuuauaa

SEQ ID NO: 6160 - RNA, 1623 nt, Artificial Sequence
  capsid_protein__Norovirus__AFQ00522
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuugugcaagccccugguggagaguucacaguguccccuagaaacgcuccaggugaaauacuauggagcgcgcccuuaggcccugaucuaaaucccuaccuaucucaucuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguggauguuagacaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuucuggugccaccuacaguugagucaagaaccaaaccauucacugucccaaucuuaacuguugaagaaaugaccaauucaagauuucccauuccuuuggaaaaauuguucacgggucccagcagugccuuuguuguucaaccacagaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacagucuacacugggagugcccccuuuacuccaaagcugggcaguguucaauucaguacugauacagaaaacgauuuugaaacucaccaaaacacaaaauucaccccagucggugucauccaggaugguggcaccacccaccgaaaugaaccccaacaaugggugcucccaaguuauucagguagaaaugucccuaauguacaucuagccccugcuguagcccccacuuuuccgggugaacaacuucuuuucuuuagguccacuaugcccggaugcagcggguaucccaacauggauuuagauugccuacucccccaggagugggugcagcacuucuaccaagaggcagcuccagcacagucugauguggcucuauugagauuugugaauccagacacggguaggguccuguuugagugcaaacuucacaaaccaggcuaugucacaguggcucauaccggccagcaugauuuggucaucccccccaaugguuauuuuagguuugauuccuggguuaaucaauucuacacacuugcccccaugggaaaugggacggggcguagacgugcuuuauaa

SEQ ID NO: 6161 - RNA, 1623 nt, Artificial Sequence
  capsid_protein__Norovirus__AFQ00523
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuugugcaagccccugguggagaguucacaguguccccuagaaacgcuccaggugaaauacuauggagcgcgcccuuaggcccugaucuuaaucccuaccuaucucaucuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguggauguuagacaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuucuggugccaccuacaguugagucaagaaccaaaccauucacugucccaaucuuaacuguugaagaaaugaccaauucaagauuucccauuccuuuggaaaaauuguucacgggucccagcagugccuuuguuguucaaccacagaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacagucuacacugggagugcccccuuuacuccaaagcugggcaguguucaauucaguacugauacagaaaacgauuuugaaacucaccaaaacacaaaauucaccccagucggugucauccaggaugguggcaccacccaccgaaaugaaccccaacaaugggugcucccaaguuauucagguagaaaugucccuaauguacaucuagccccugcuguagcccccacuuuuccgggugaacaacuucuuuucuuuagguccacuaugcccggaugcagcggguaucccaacauggauuuagauugccuacucccccaggagugggugcagcacuucuaccaagaggcagcuccagcacagucugauguggcucuauugagauuugugaauccagacacggguaggguccuguuugagugcaaacuucacaaaccaggcuaugucacaguggcucauaccggccagcaugauuuggucaucccccccaaugguuauuuuagguuugauuccuggguuaaucaauucuacacacuugcccccaugggaaaugggacggggcguagacgugcuuuauaa

SEQ ID NO: 6162 - RNA, 1623 nt, Artificial Sequence
  capsid_protein__Norovirus__AFQ00524
augaagauggcgucgaaugacgccaacccaucugauggguccgcagccaaccucgucccagaagucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguacaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccuuuaccugauguuaggaauaacuucuaucauuauaaucaaucaaaugauuccaccauuaaauugauagcaaugcuguauacaccacuuagggcuaauaaugcuggggaagaugucuucacagucucuugucgaguccucacgaggccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaaguugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6163 - RNA, 1623 nt, Artificial Sequence
  capsid_protein__Norovirus__AFQ00525
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuugacuguugaggagaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaacgauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6164 - RNA, 1623 nt, Artificial Sequence
  capsid_protein__Norovirus__AFQ00526
augaagauggcgucgaaugacgccaacccaucugauggguccgcagccaaccucgucccagaggucaacaaugagguaauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugauuugaaucccuaccuaucucauuuggccaggauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaguuggaaccuguguugaucccccuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggccccagcagugccuuuguuguucaaccacaaaauggcagaugcacgacugauggugugcucuuaggcaccacccaacugucuccugucaauaucugcaccuucagaggggaugucacccacauugcagguucucacaauuacgcaaugaauuuggccucucuaaauuggaacaauuaugacccaacagaagagauuccagccccucuaggaacuccagauuuuguaggaaagauccaaggugugcucacucaaaccacaaagggagaugguucgacccguggccauaaagcuacaauuuacacugggagugcccccuuuacuccaaagcugggcaguguucaauucaguacugauacagaaaaugauuuugaaacucaccaaaacacaaaauucaccccagucgguguuauccaggauggugguaccacccaccgaaaugaaccccaacaaugggugcucccaaguuauucagguagaaaugucccuaauguacaccuagccccugcuguagccccuacuuucccgggugaacaacuccuuuucuuuaggucuacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaucucacgguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6165 - RNA, 1623 nt, Artificial Sequence
  capsid_protein__Norovirus__AFQ00527
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugauuugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucaaucaaaugacucuaccauuaaauugauagcaaugcuguacacaccacuuagggcuaauaaugcuggggaagaugucuucacagucucuugucgaguccucacgaggccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaaugugcaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6166 - RNA, 1623 nt, Artificial Sequence
  capsid_protein__Norovirus__AFQ00528
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucaaucaaaugauccuaccauuaaauugauagcaaugcuguauacaccacuuagggcuaauaaugcuggggaagacgucuucacagucucuugucgaguccucacgaggccauccccugauuuugauuuuauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaaugcacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagauacggguaggguccuauuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6167 - RNA, 1644 nt, Artificial Sequence
  capsid_protein__Norovirus__AGC66782
augaagauggcgucgaaugacgcugcuccaucgaaugauggagcugccaaccucguaccagaggccaacaaugagguuauggcacuugaaccgguggugggagcuucaauugcagcuccugucgucggucaacaaaauauaauugaccccuggauuagagaaaauuuuguucaggcaccacagggugaguuuacuguuucaccaagaaacucgccuggugagaugcuucuaaaucuugaauuaggcccagagcucaauccuuacuugagucauuuaucccgcauguacaaugguuaugcugguggcaugcagguucaggugguccuagcugggaaugcguucacagcugguaaaaucaucuuugccgccguuccaccacauuucccuguagagaacauuagugcagcucaaauuacaaugugcccccaugugauuguugaugugagacagcuugaaccuguacuuuugccucucccugacauaaggaacagauucuuucauuacaaccaggaagacaccccccggaugagacuuguggccauguuguacacaccucuuagagcaaacucuggugaggauguguucacugugucuugcagagucuugacccgcccagccccugacuuugaguucacauucuuagugccaccaaccguggaaucaaagaccaagccuuuuacacuccccauuuuaacccuaggggaauuauccaacuccagauuccccgcuccaauagacaugcuguacacagauccuaaugaaacaauugugguacaaccacaaauuggcagaugcacccuagaugggucacuccaagggaccacccagcuggugcccacccaaauuugcucuuuugggggcacguugaucagccaaacgucgaggucagcagauucaacagacucagcuccacgggugaggaaccauccccuucacguucagcugaagaaccucgacgggacaccauaugacccaacagaugaggugccggcaguucugggugccauagacuucaaaggaacuguguuuggagucgcuagccagagaaacacuacagggggcucuguaggggcgacucgugcccaugaggugcacauagacaccacaaacccuagauacaccccaaaacuugguucugcguugauguauucugagucugaugauuuugaugauggacaaccaacccgcuucacacccauuggcaugggggcagaugauuggcaccaaugggaauugcccgaauauucaggucaccucacccuuaacaugaaccuagcccccgcaguugcuccugcuuuccccggugagcgcauccucuucuucaggucagugguuccaucugcuggugguuacggaucaggccaaauagacugccuuaucccacaggaguggguucagcacuucuaucaggaggccgccccaucacaaucugcgguggcucuuauuagauauguuaacccugacacugggagaaacauccuugaggcaaagcuacacagagaaggguucauuacuguggcaaauucuggaaauaaccccauaguugugcccccaaauggcuauuucagguuugaggccugggucaaucaauucuacacgcucacccccaugggaacuggacaggggcgcaggagaguccaauaa

SEQ ID NO: 6168 - RNA, 1623 nt, Artificial Sequence
  capsid_protein__Norovirus__AGC66784
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagccaggucaccauguucccccauauaauaguggauguuaggcaauuggaaccuguguugauccccuuaccugauguuaggaauaauuucuaucacuauaaucagucaaaugauucuacuauuaaauugauagcaaugcuuuauacaccacuuagggcuaauaaugcuggggaagaugucuuuacaguuucuugccgaguucucacgaggccauccucugauuuugauuucauauuuuuggugccaccuacaguugagucaagaacuaagccauuuacugucccaaucuuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccugucaacaccugcaccuucagaggggaugucacccacauugcagguucucguaauuacacaaugaauuuggcuucucuaaauuggaacaauuaugacccaacagaagaaauuccagccccucuagggacuccagauuucgugggaaagauccaaggugugcucacucaaaccacaaagggagauggcucgacccguggccauaaagcuacaauuuacacugggagugcccccuucacuccaaagcugggcaguguccaauucaauacugacacagaaaaugauuuugaaacccaccaaaacacaaaauucaccccagucggugucauccaggaugguggcaccacccaccgaaaugaaccucaacaaugggugcucccgaguuauucagguagaaauaucccuaauguacaccuagccccugcuguagcccccacuuucccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaaugguuauuuuagguuugauuccuggguuaaucaauucuacacgcuugcccccaugggaaauggaacggggcguagacgugcuuuauaa

SEQ ID NO: 6169 - RNA, 1647 nt, Artificial Sequence
  capsid_protein__Norovirus__AGC66785
augaagauggcgucgaaugacgccacuccaucuaaugauggugccgccggccucgucccagagaucaacagugaggcaauggcgcuagagccaguggcgggcgcagcgauagcagcaccccucacuggucagcaaaauauaauugaucccuggauuaugaauaauuuugugcaagcaccugguggugaguuuacaguauccccuagaaauuccccuggugaaguucuucucaauuuggaauuggguccagaaauaaaucccuauuuggcccaucuugcuagaauguauaaugguuaugcagguggauuugaagugcaggugguccuagcuggaaaugcguuuacagcaggaaagauaaucuuugcagcuauccccccuaauuuuccaauugauaaucuaagugcagcacagaucacaauguguccacaugugauuguggaugucagacaguuggaaccagucaaccuuccgaugccugacguucgcaacaacuucuuccauuacaaucaagggucugauucgagauugcgccuaauugcaaugcuauauacaccucuuagggcaaauaauucuggggaugauguuuucacugugucuugcagagugcuaacuagaccuaguccugacuucucauuuaauuuccuugugccacccacuguggagucaaagacaaaacccuuuucccucccuauucugacuaucucugaaauguccaauucuagguucccaguaccaauugauucuuugcacaccagcccuacugagaacauuguuguccagugucagaauggacgcgucacccuugauggugaguugaugggcaccacccaacucuuaccuagccaaaucugugcuuucaggggcaugcucaccagaucaacaagcagggccagugaccaggccgauacagcaacuccuagauuguuuaauuauuauuggcauauacaauuggauaaucuaaauggaacuccuuaugacccugcagaagacauaccaggcccccuagggacaccagauuuccggggcaaagucuucggcguggccagccagagaaauccugaugccacgacuagggcacaugaagcaaagauagacacaacaucuggccgcuucaccccaaaauuaggcucacuugagauuuccacugagucuggagauuuugaucaaaaccaaccaacaagauucaccccaguuggcauugggguugaucgugaggcagacuuucaacaauggacucuucccgacuaugcuggucaguucacacacaacaugaacuuagccccagcuguugcuccaaacuucccuggcgagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguauaucaacccugacacugguagaguguuauuugaggccaaacugcacaaauuagguuucaugacuauagccaagaguggugauucuccaauaacugucccuccaaauggauauuuuagguuugaaucuugggugaaccccuuuuauacacuugcccccaugggaacugggaacgggcguagaaggauucaauaa

SEQ ID NO: 6170 - RNA, 1644 nt, Artificial Sequence
  capsid_protein__Norovirus__AGC66786
augaagauggcgucgaaugacgcugcuccaucgaaugauggagcugccaaccucguaccagaggccgacaaugagguuauggcacuugaaccgguggugggagcuucaauugcagcuccugucgucggucaacaaaauauaauugaccccuggauuagagaaaauuuuguucaggcaccacagggugaguuuacuguuucaccaagaaacucgccuggugagaugcuucuaaaucuugaauuaggcccagggcucaauccuuacuugagucauuuaucccgcauguacaaugguuaugcugguggcaugcagguucaggugguccuagcugggaaugcguucacagcugguaaaaucaucuuugccgccguuccaccacauuucccuguagagaacauuagugcagcucaaauuacaaugugcccccaugugauuguugaugugagacagcuugaaccuguacuuuugccucucccugacauaaggaacagauucuuucauuacaaccaggaagacaccccccggaugagacuuguggccauguuguacacaccucuuagagcaaacucuggugaggauguguucacugugucuugcagagucuugacccgcccagccccugacuuugaguucacauucuuagugccaccaaccguggaaucaaagaccaagccuuuuacacuccccauuuuaacccuaggggaauuauccaacuccagauuccccgcuccaauagacaugcuguacacagauccuaaugaaacaauugugguacaaccacaaaguggcagaugcacccuagaugggacacuccaagggaccacccagcuggugcccacccaaauuugcucuuuuaggggcacguugaucagccaaacgucgaggucagcagauucaacagacucagcuccacgggugaggaaccaucccccucacguucagcugaagaaccucgacgggacaccauaugacccaacagaugaggugccggcaguucugggugccauagacuucaaaggaacuguguuuggagucgcuagccagagaaacacuacagggggcucuguaggggcgacucgugcccaugaggugcacauagacaccacaaacccuagauacaccccaaaacuugguucuguguugauguauucugagucugaugauuuugaugauggacaaccaacccgcuucacacccauuggcaugggggcagaugauuggcaccaaugggaauugcccgaauauucaggucaccucacccuuaacaugaaccuagcccccgcaguugcuccugcuuuccccggugagcgcauccucuucuucaggucagugguuccaucugcuggugguuacggaucaggccaaauagacugccuuaucccacaggaguggguucagcacuucuaucaggaggccgccccaucacaaucugcgguggcucuuauuagauauguuaacccugacacugggagaaacaucuuugaggcaaagcuacacagagaaggguucauuacuguggcaaauucuggaaauaaccccauaguugugcccccaaauggcuauuucagguuugaggccugggucaaucaauucuacacgcucacccccaugggaacuggacaggggcgcaggagaguccaauaa

SEQ ID NO: 6171 - RNA, 1623 nt, Artificial Sequence
  capsid_protein__Norovirus__AGC66788
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucaaucaaaugauucuaccauuaaguugauagcaaugcuguauacaccacuuagggcuaauaaugcuggggaagaugucuucacagucucuugucgaguccucacgaggccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagcuccucuaggaacuccagauuucgugggaaagauccaaggugugcucacucaaaccacuaagggggaugguucgacccguggccauaaagcuacaguuuacacugggagugcccccuuuacuccaaagcugggcaguguucgauucaguacugauacagaaaaugauuuugaaacucaccaaaacacaaaauucaccccagucggugucauccaggaugguggcaccacccaccgaaaugaaccccaacaaugggugcucccaaauuauucagguagugaugucccuaauguacaccuagccccugcuguagcccccaauuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugaauguaaacuccauaaaucaggcuaugucacaguggcucacaccggccagcaugauuuggucaucccccccaaugguuauuuuagguuugauuccuggguuaaucaauucuacacacuugcccccaugggaaauggaacggggcgcagacgugcuuuauaa

SEQ ID NO: 6172 - RNA, 1629 nt, Artificial Sequence
  capsid_protein__Norovirus__AGL96587
augaagauggcgucgaaugacgccgcuccaucaaaugauggugcagcuagucucguaccagagggcauuaaugagacuaugccauuggaacccguugcuggugcaucuauugcugccccaguggcgggacaaaccaacauaauugaccccuggauaagaacaaauuuuguacaagccccuaauggagaguuuacagugucaccaagaaauuccccuggagaaauuuuauuaaauuuagaauuaggaccagaucugaauccuuauuuggcccaucuuccuagaauguauaaugguuaugcuggagguguugaggugcaagugcuccucgcugggaacgcguucacagcagguaagauauuguuugcagcaaucccaccuaacuuuccuguagauaugauuagcccagcucaaauuacuaugcuuccccauuugauuguagauguuagaacuuuggaaccuauuaugauacccuugccugauguuaggaauguguucuaucauuuuaauaaucaaccucaaccuagaaugagauuaguggcuaugcuuuauacccccuugaggucuaaugguucaggggaugauguccucacugugucuuguagagugcuaacuaggccaacuccugauuuugaauuuaucuaucuggugcccccuucuguagaguccaaaacuaaaccauucacacuaccaauauuaaccauuucugaauugaccaacucccgguucccuauuccaaucgagcaauuguauacggcuccaaaugagaccaauguuguccagugucagaauggcagaugcaccuuagauggagagcuccagggcacaacccagcuguugucaagugcaguuugcucuuacaggggcaggacuguggccaauaauggggauaauugggaucaaaauuugcuccagcugaccuauccaaauggugcaagcuaugaccccacugaugaagugccggcaccauugggcacucaagauuuuagugggauguuguauggaguguugacccaggacaaugugaaugugagcacaggagaggccaaaaaugcuaaggggauauacauauccaccacuagugggaaauucaccccaaaaauugggucaauuggauugcauucaauaacugagcacgugcaccccaaccaacagucgcgguucacccccguuggagucgccgugaaugagaacacccccuuucagcaauggguucugccacauuaugcagguaguacucgcucucauaccaauuugggcacugcucuugccccgacuuucccuggugagcaauugcuguucuucaggucccgugucccauguguccaaggccuacaggggcaggaugcguucauagauugccuccugccccaagagugggugaaucauuuuuaccaagaggcagccccuucccaagcagacgucgcccuuauuagguaugucaacccugauacuggucguacgcuguuugaagccaaguugcauagaucagguuucaucacugugucacauacuggugcuuacccucuuguaguccccccaaauggucauuuuagguuugauucuuggguuaaucaauuuuacucacucgcccccaugggaacugguaaugggcguagaagaauccaguaa

SEQ ID NO: 6173 - RNA, 1623 nt, Artificial Sequence
  capsid_protein__Norovirus__AGQ57036
augaagauggcgucgaaugacgcagcuccaucuaaugauggugcagcaggccucguaccagagaucaacaaugaggucaugccccuugagcccguggcuggugcaucgcuggcgacaccaguugucgggcaacaaaauauaauugaucccuggauaagaaauaauuuugugcaagcuccugcaggugaguuuacaguuuccccuagaaauuccccuggugaaauuuugcuugauuuggaguuggggccagaauugaaccccuaucuugcucaucuggcccguauguacaaugggcacgcugguggcauggaagugcaaauuguguuggcugggaacgcguucacagcuggcaagaucauauuugcugccaucccuccaggguucccauaugaaaacuugucaccuucacaaauuacaaugugcccucauguuauaauugauguuagacaauuagaaccaguccuauuaccuaugccagauaucagaaauaacuucuuccauuauaaucagggcaacgauccaaaauugagguugguagcuaugcucuauaccccuuuaagagcuaauaauucuggugaugauguguucacaguuucuuguaggguccucacuaaaccgucaccugauuuugaauucacauuucuaguucccccuacgguugaauccaaaaccaagcaguuuacauugcccauccucaaaauaucagagaugaccaacucaagauucccagugccaguugaaaugauguacacagccaggaaugagaaccaaguuguccagccacagaaugguagggucacacuugauggcgaacuauuaggcaccacacccuuguuggcugucaacaucugcaaauucaagggagagguuauagcuaagaauggagaugugagauccuauaggauggacauggaaaucaccaacacugauggcacuccaauugaccccacagaagacacaccuggucccauugguucaccugauuuucaagguauacucuuuggcguugccagccaacgcaacaagaaugagcaaaaucccgccacgagagcccaugaagccgacauuaacacugguggggaccaauaugcccccaaauuggcccaagugaaauucuucucagagucccaggauuucgaggugcaccagcccacaguuuucaccccaguugguguggcaggcgacgcuucccacccuuucagacaguggguccugccucgauacgguggacaucucaccaauaacacccacuuggcuccagcaguggccccucuauucccaggugagcagauucuauucuuuagaucacaaauaccuagcucaggcggccaugaauuggguuacauggacugccuugucccacaagaauggguccagcacuucuaucaagaagcugccacagcucagucugagguggcacucauaagguucaucaacccagacacuggcagaguccucuuugaggccaagcugcacaagcaaggcuucauaacuguggcucacacuggugauaacccaauugucaugccaccaaauggguacuuuagauuugaagccuggguuaaucaguuuuacucacucgcccccgugggaacugggaaugggcgcaggaggauccaauaa

SEQ ID NO: 6174 - RNA, 1623 nt, Artificial Sequence
  capsid_protein__Norovirus__AGT95926
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuacuuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucugggaacuccagauuuuguggggaagauucaaggcgugcucacccaaaccacaaggacagacggcucaacacgcggccacaaagcuacaguguacacugggagcgccgacuuugcuccaaaauuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguaguauaa

SEQ ID NO: 6175 - RNA, 1623 nt, Artificial Sequence
  capsid_protein__Norovirus__AGT95927
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacucagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaauuggguagaguucaguuugaaacugacacagaucaugauuuugaaguuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguaguauaa

SEQ ID NO: 6176 - RNA, 1623 nt, Artificial Sequence
  capsid_protein__Norovirus__AGT95928
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaacuucuaccauuacaaucaaucaaaugaccccacuauuaaguugauagcaauguuguauacaccacuuagggcuaauaaugcuggggacgaugucuucacagucucuugccggguccucacgagaccaucccccgacuuugauuucauauuucuagugccacccacaguugagucaagaacuaagccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucagcaucugcaccuucagaggggaugucacccacaucacagguagucguaacuacacaaugaauuuggcuucucaaaauuggaacaauuacgacccaacagaagaaaucccagccccucuaggaacuccagauuuuguagggaagauucaagguaugcucacccaaaccacaagggcagauggcucaacacgcggccacaaagcuacaguguacacugggagcgccgauuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuccucuucuucagauccaccaugcccggaugcagcggguaccccaauauggauuuggacugucugcucccccaggaaugggugcaguacuucuaccaagaggcagccccagcacaaucugauguggcucugcuaagauuugugaauccagacacagguaggguuuuguuugaguguaagcuucauaagucaggcuauguuacaguggcucacacuggccaacaugauuugguuaucccccccaaugguuauuuuagguuugauuccugggucaaccaguucuacacgcuugcccccaugggaaauggaacggggcguagacguguaguauaa

SEQ ID NO: 6177 - RNA, 1623 nt, Artificial Sequence
  capsid_protein__Norovirus__AGT95929
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuugacuguugaggagaugaccaauucaagauuccccauuccuuuggaaaaguuguuuacgggucccagcagugccuuuguuguccaaccacaaaacggcaggugcacgacugauggcgugcuccuaggcaccacucaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuugugggaaagauucaaggcgugcucacccaaaccacaaggacagauggcucaacacgcggccacaaagcuacaguguacacugggagcgccgacuuugcuccaaaauuggguagaguucaauuugaaacugacacagaucaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguaaacguguaguauaa

SEQ ID NO: 6178 - RNA, 1623 nt, Artificial Sequence
  capsid_protein__Norovirus__AGT95930
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaaugcguucaccgcugggaaggucauauuugcagcagucccaccaaauuuuccaacugaaggcuugagccccagccaggucacuauguucccccauauagugguagauguuaggcaacuagaaccuguguugauucccuuacccgauguuaggaauaauuucuaucauuauaaucaaucaaaugaccccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggccucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggaguaccgacuuugcuccaaaacuggguagaguucaauuugaaacugacacagaccaugacuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugaacaacuucucuucuucagauccaccaugcccggaugcagcggguaccccaacauggauuuggacugucugcucccucaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacgugcaguauaa

SEQ ID NO: 6179 - RNA, 1623 nt, Artificial Sequence
  capsid_protein__Norovirus__AGT95931
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcacccuugggcccugaucuaaaucccuaccuaucccauuuggccagaauguacaaugguuaugcaggugguuuugaagugcaaguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcgugcuuacccaaaccacaaggacagauggcucaacacgcggccacaaagccacaguguacacugggagcgccgacuuugcuccaaaacuggguagaguucaauuugaaacugacacagaccaugauuuugaaacuaaccaaaacacaaaguucaccccagucggugucauccaagaugguagcaccacccaccgaaaugaaccccaacagugggugcucccaaguuacucaggcagaaauacucauaaugugcaucuggcccccgcuguagccccuacuuuuccgggugagcaacuccucuucuucagguccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacgugcaguauaa

SEQ ID NO: 6180 - RNA, 1623 nt, Artificial Sequence
  capsid_protein__Norovirus__AHC12655
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccacauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggacgaugucuccacaguuucuugccgaguucucacaagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaaucggugucauccaagaugguagcaccacccaccgaaaugaaccccaacagugggugcucccaaguuacucaggcagaaauacucauaaugugcaucuggcccccgcuguagcucccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauucuugggucaaccaguucuacacgcuugcccccaugggaaauggaacggggcguagacguguaguauaa

SEQ ID NO: 6181 - RNA, 1623 nt, Artificial Sequence
  capsid_protein__Norovirus__AHC12658
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcaaucccaccaaauuuuccaacugaaggcuuaagucccagccaggucacuauguucccccacauaguaguagauguuaggcaacuagaaccuguguugauucccuuacccgauguuaggaauaauuucuaucauuauaaccaaucaaaugaccccaccauuaaguugauagcaauguuguauacaccacuuagggcuaauaaugcugggggcgaugucuucacaguuucuugccgaguucucacaagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguacacuggaagcgccgacuuugcuccaaaacuggguagaguucaauuugaaacugacacagaccaugauuuugaagcuaaccaaaucacaaaguucaccccaaucggugucauccaagaugguagcaccacccaccgaaaugaaccccaacagugggugcucccaaguuacucaggcagaaauacucauaaugugcaucuggcccccgcuguagcucccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauucuugggucaaccaguucuacacgcuugcccccaugggaaauggaacggggcguagacguguaguauaa

SEQ ID NO: 6182 - RNA, 1632 nt, Artificial Sequence
  capsid_protein__Norovirus__AHW99832
augaugauggcgucuaaggacgccccaucaagcgcagauggcgcgaauggcgccggucagcuugugccggagguuaauaaugcugaaccacugccacuugauccaguggcgggggcuuccaccgcccuugccacugcuggacaaguuaauaugauugacccauggaucuucaacaacuuuguccaggccccucagggugaauuuacuauuuccccaaauaauacccccggugauauuuuguuugauuuacaauuagguccacaucuaaauccuuuucuagcacauuuaucucaaauguauaauggcuggguuggcaauaugcggguuaggguuaucuuggccggcaaugcuuucacugcugguaaaguuauaaucuguuguguuccccccggcuuucaaucuagaacucuuucuauagcccaggcuacacucuuuccccacaucauagcugaugugcgaacucuggaaccaauugagaucccucuggaggacguuaggaauacucucuaucauacuaaugacaaucaaccaacaaugcgcuuauugugcaugcuuuacacgccacugcgcaccgguggcggcucugguggcacagaugcguuuguuguggcaggccgaguauuaacuuguccuaguucugauuuuaauuucuuauuucuagucccuccuacuguagagcagaaaacacgccccuuuaguguaccuaacauacccuugcaguugcugucuaauucccgcguccccaaucucauacaaagcaugguccuuucgccugaucaggcucagaauguccaauuucagaacggccgcugcacuaccgaugggcagcucuuggguacaacaccugucucaguuagucagauucuaaaguuuagaggaaaggugucagcuggcucuaaagucaucaaccuuacugaacuggaugguucccccuuucuagcuuuugaggccccagcacccacggguuuuccugaccugggaaccagugauuggcauguugagaugagccucaacucaaauagccagagcucuggcaacccuauuuuguugagggacauacacccaaauuccucagaauuugugccgcauuugggcagugugugugucaccgcugcaauugaagucgcuggggauuacacuggcacaauucaauggaccucucaaccaucuaacgucacuccaguccccgaugucaacuucuggaccaucccccauuauggaucaaauuuggcagaagccucccaguuggccccugugguguaccccccaggauuuggugaagcuauaguguauuuuaugucccccauaccaggcccaaacacugcacacaaacccaauuugguaccuugccuacucccacaagaauuuguaacacauuuugucagugaacaagcuccauccaugggugaggcagcccuuguccauuauguugacccagacacuaaucgcaacuugggugaguucaaauuguacccugaggguuuuaucacaugugugccgaauggcacuggcccacaacaacucccucuuaauggaguuuuugucuuugcuuccugggucuccagauuuuaucaauuaaagccugugggaacggccagcucggccagagguaggcuuggaguuagaagauaa

SEQ ID NO: 6183 - RNA, 1647 nt, Artificial Sequence
  capsid_protein__Norovirus__AHZ12735
augaagauggcgucgaaugacgccacuccaucuaaugauggugccgccggccucgucccagagaucaacaaugaggcaauggcgcuagagccaguggcgggugcagcgauagcggcaccccucacuggccagcaaaauauaauugaucccuggauuaugaauaauuuugugcaagcaccugguggugaguucacagugucuccuaggaauuccccuggugaagugcuccucaauuuggaauugggccaagaaauaaaccccuaucuggcccaucuugcuagaauguauaaugguuaugcagguggguuugaagugcagguaguccuagcuggaaaugcguuuacagcaggaaagauaaucuuugcagcuauacccccuaacuucccaauugacaaucuaagugcagcacagaucacaaugugcccacaugugauuguggauguuaggcaguuggaaccggucaaccucccgaugccugacguucgcaauaacuucuuccacuacaaccaagggucugauucgagauugcgcuugguugcaaugcuguacacaccucuuagggcaaauaacucuggggaugauguuuucacugugucuuguagagugcugacuagaccuagcccugaauuuucauuuaacuuccuugugccacccacuguggagucaaagacaaaacccuucacccucccaauucugacuaucucugaaaugucuaauucuagguuuccagugccgauugauucucugcacaccagcccaacugagaauauuguuguccagugccaaaauggacgcgucacucuugauggugaguugaugggcaccacucagcucuuaccuagucaaaucugugcuuucaggggcgugcucacuagaucaacaagcaggacuagugaccaggccgacacagcaaccccuagauuguuuaauuauuauuggcacauacaauuggauaaucuaaaugggacuccuuaugauccugcagaagacauaccaggcccccuggggacgccagauuuccggggcaaagucuuuggcguggccagccaaagaaaccccgacaguacaacuagagcacaugaagcaaagguggacacaacagcuggucgcuucaccccaaaacuaggcucauuagagauauccacugaaucuggcgacuuugaccaaaaccaaccaacaagauucaccccaguuggcauugggguugaccgcgaggcagacuuccaacaaugguccuuacccgacuacucuggccaguucacucacaacaugaacuuagccccagcuguugcucccaacuucccuggugagcagcuccuuuucuuccgcucacaguuaccaucuucuggugggcgauccaaugggauucuagacugccuggucccccaagaauggguucagcacuucuaccaagaaucagcccccgcccaaacccagguggcucugguuagauaugucaacccugacacugguagaguguuguuugaggccaagcugcacaaauuagguuucaugacuauagcuaagaauggugauucuccaauaacuguccccccaaauggauacuuuagguuugaaucuugggugaacccauuuuauacacuugcccccaugggaacugguaaugggcguagaagaguucaauaa

SEQ ID NO: 6184 - RNA, 1647 nt, Artificial Sequence
  capsid_protein__Norovirus__AHZ12736
augaagauggcgucgaaugacgccacuccaucuaaugauggugccgccggccucgucccagagaucaacaaugaggcaauggcgcuagauccaguggcgggugcagcgauagcagcaccccucacuggccagcaaaauauaauugaucccuggauuaugaauaauuuugugcaagcaccugguggugaguucacagugucuccuaggaauuccccuggugaagugcuccucaauuuggaauugggcccagagauaaaccccuaucuggcccaucuugcuagaauguauaaugguuaugcagguggguuugaagugcagguaguccuagcuggaaaugcguuuacagcaggaaagauaaucuuugcagcuauacccccuaacuucccaauugacaaucuaagugcagcacagaucacaaugugcccacaugugauuguggaugucaggcaguuggaaccggucaaccucccgaugccugacguucgcaauaacuucuuccacuacaaccaagggucugauucgagauugcgcuugguugcaaugcuguacacaccucuuagggcaaauaacucuggggaugauguuuucacugugucuuguagagugcugacuagaccuagcccugaauuuucauuuaacuuccuugugccacccacuguggagucaaagacaaaacccuucacccucccaauucugacuaucucugaaaugucuaauucuagguuuccagugccgauugauucucugcacaccagcccaacugagaauauuguuguccagugccaaaauggacgcgucacucuugauggugaguugaugggcaccacucagcucuuaccuagucaaaucugugcuuucaggggcgugcucacuagaucaacaagcagggcuagugaccaggccgacacagcaaccccuagauuguuuaauuauuauuggcacauacaauuggauaaucuaaaugggacuccuuaugauccugcagaagacauaccaggcccccuggggacaccagauuuccggggcaaagucuuuggcguggccagccaaagaaaccccgacaauacaacuagagcacaugaagcaaagguggacacaacagcuggucgcuucaccccaaaacuaggcucauuagagauauccacugaaucuggugacuuugaccaaaaccaaccaacaagauucaccccaguuggcauugggguugaccacgaggcagacuuccaacaaugguccuuacccgacuacucuggccaguucacucacaacaugaacuuagccccagcuguugcucccaacuucccuggugagcagcuccuuuucuuccgcucacaguuaccaucuucuggugggcgauccaaugggauucuagacugccuggucccccaagaauggguucagcacuucuaccaagaaucagcccccgcccaaacccagguggcucugguuagauaugucaacccugacacuggcagaguguuguuugaggccaagcugcacaaauuagguuucaugacuauagcuaagaauggugacucuccaauaacuguccccccaaauggauacuuuagguuugaaucuugggugaacccauuuuauacacuugcccccaugggaacugggaaugggcguagaagaguucaauaa

SEQ ID NO: 6185 - RNA, 1647 nt, Artificial Sequence
  capsid_protein__Norovirus__AHZ12737
augaagauggcgucgaaugacgcugcuccaucuaaugauggugcugccggccucgucccagagaucaacagugaggcaauggcgcuagagccaguggcgggugcagcgauagcggcaccccucacuggucagcagaauauaauugaucccuggauuaugaauaauuuugugcaagcaccugguggugaguuuacaguaucuccuagaaauuccccuggugaaguucuucuuaauuuggaauuggguccagaaauaaaucccuauuuggcccaucuugcuagaauguauaaugguuaugcagguggauuugaagugcaggugguccuagcuggaaaugcguuuacagcaggaaagauaaucuuugcagcuauccccccuaauuuuccaauugacaaucuaagugcagcacagaucacaauguguccacaugugauuguggaugucagacagcuggaaccagucaaccucccgaugccugacguucgcaacaacuucuuucauuacaaucaagggucugauucgagauugcgccuaauugcaaugcuauacacaccucuuagggcaaacaauucuggggaugauguuuuuacugugucuuguagagugcuaacuagaccuagcccugacuucucauuuaauuuccuugugccacccacuguggagucaaagacaaaaccuuuuucccuuccuauucugacuaucuccgaaauguccaauucuagguucccaguaccaauugauucucugcacaccagcccuacugagaacauuguuguccagugucagaauggacgagucacccuugauggugaguugaugggcaccacccaacucuuaccuagccaaaucugugcuuucaggggcacgcucaccagaucaacaagcagggccagugaccaggccgacacagcaaccccuagauuguuuaauuacuauuggcauauacaauuggacaaccuaaauggaacuccuuaugacccugcagaagauauaccaggcccccuagggacaccagauuuccggggcaaagucuuuggcguggccagccagagaaauccugacgccacgacuagggcacaugaagcaaagauagacacaacaucuggccgcuuuaccccaaaauuagguucacuagagauuuccacugagucugaugauuuugaccaaaaccaaccaacaagauucaccccaguuggcguugggguugaccaugagccagacuuucaacaauggguucuucccgacuaugcaggccaguucacccacaacaugaacuuagccccagcuguugcucccaacuucccuggugagcagcuccuuuucuuccgcucacaguugccgucuucuggugggcgguccaacgggauucuagacugccuggucccccaagaaugggugcagcauuucuaccaagaaucagcccccucccaaacccaaguggcccuaguuagguaugucaacccugacacugguaggguguuauuugaggccaagcuacacaaauuagguuucaugacuauagccaagaguggugacuccccgauaacuguccccccaaauggauauuuuagguuugaaucuugggugaaccccuuuuauacacuugcccccaugggaacuggaaaugggcguagaaggauucaauaa

SEQ ID NO: 6186 - RNA, 1647 nt, Artificial Sequence
  capsid_protein__Norovirus__AHZ12738
augaagauggcgucgaaugacgccacuccaucuaaugauggugccgccggccucgucccagagaucaacaaugaggcaauggcgcuagauccaguggcgggugcagcgauagcagcaccccucacuggccagcaaaauauaauugaucccuggauuaugaauaauuuugugcaagcaccugguggugaguucacagugucuccuaggaauuccccuggugaagugcuccucaauuuggaauugggcccagagauaaaccccuaucuggcccaucuugcuagaauguauaaugguuaugcagguggguuugaagugcagguaguccuagcuggaaaugcguuuacagcaggaaagauaaucuuugcagcuauacccccuaacuucccaauugacaaucuaagugcagcacagaucacaaugugcccacaugugauuguggaugucaggcaguuggaaccggucaaccucccgaugccugacguucgcaauaacuucuuccacuacaaccaagggucugauucgagauugcgcuugguugcaaugcuguacacaccucuuagggcaaauaacucuggggaugauguuuucacugugucuuguagagugcugacuagaccuagcccugaauuuucauuuaacuuccuugugccacccacuguggagucaaagacaaaacccuucacccucccaauucugacuaucucugaaaugucuaauucuagguuuccagugccgauugauucucugcacaccagcccaacugagaauauuguuguccagugccaaaauggacgcgucacucuugauggugaguugaugggcaccacucagcucuuaccuagucaaaucugugcuuuuaggggcgugcucacuagaucaacaagcagggcuagugaccaggccgacacagcaaccccuagauuguuuaauuauuauuggcacauacaauuggauaaucuaaaugggacuccuuaugauccugcagaagacauaccaggcccccuggggacaccagauuuccggggcaaagucuuuggcguggccagccaaagaaaccccgacaguacaacuagagcacaugaagcaaagguggacacaacagcuggucgcuucaccccaaaacuaggcucauuagagauauccacugaaucuggugacuuugaccaaaaccaaccaacaagauucaccccaguuggcauugggguugaccacgaggcagacuuccaacaaugguccuuacccgacuacucuggccaguucacucacaacaugaacuuagccccagcuguugcucccaacuucccuggugagcagcuccuuuucuuccgcucacaguuaccaucuucuggugggcgauccaaugggauucuagacugccuggucccccaagaauggguucagcacuucuaccaagaaucagcccccgcccaaacccagguggcucugguuagauaugucaacccugacacugguagaguguuguuugaggccaagcugcacaaauuagguuucaugacuauagcuaagaauggugacucuccaauaacuguccccccaaauggauacuuuagguuugaaucuugggugaacccauuuuauacacuugcccccaugggaacugggaaugggcguagaagaguucaauaa

SEQ ID NO: 6187 - RNA, 1647 nt, Artificial Sequence
  capsid_protein__Norovirus__AHZ12739
augaagauggcgucgaaugacgccacuccaucuaaugauggugccgccggccucgucccagagaucaacaaugaggcaauggcgcuagauccaguggcgggugcagcgauagcagcaccccucacuggccagcaaaauauaauugaucccuggauuaugaauaauuuugugcaagcaccugguggugaguucacagugucuccuaggaauuccccuggugaagugcuccucaauuuggaauugggcccagagauaaaccccuaucuggcccaucuugcuagaauguauaaugguuaugcagguggguuugaagugcagguaguccuagcuggaaaugcguuuacagcaggaaagauaaucuuugcagcuauacccccuaacuucccaauugacaaucuaagugcagcacagaucacaaugugcccacaugugauuguggaugucaggcaguuggaaccggucaaccucccgaugccugacguucgcaauaacuucuuccacuacaaccaagggucugauucgagguugcgcuugguugcaaugcuguacacaccucuuagggcaaauaacucuggggaugauguuuucacugugucuuguagagugcugacuagaccuagcccugaauuuucauuuaacuuccuugugccacccacuguggagucaaagacaaaacccuucacccucccaauucugacuaucucugaaaugucuaauucuagguuuccagugccgauugauucucugcacaccagcccaacugagaauauuguuguccagugccaaaauggacgcgucacucuugauggugaguugaugggcaccacucagcucuuaccuagucaaaucugugcuuucaggggcgugcucacuagaucaacaagcaggacuagugaccaggccgacacagcaaccccuagauuguuuaauuauuauuggcacauacaauuggauaaucuaaaugggacuccuuaugauccugcagaagacauaccaggcccccuggggacaccagauuuccggggcaaagucuuuggcguggccagccaaagaaaccccgacaguacaacuagagcacaugaagcaaagguggacacaacagcuggucgcuucaccccaaaacuaggcucauuagagauauccacugaaucuggugacuuugaccaaaaccaaccaacaagauucaccccaguuggcauugggguugaccacgaggcagacuuccaacaaugguccuuacccgacuacucuggccaguucacccacaacaugaacuuagccccagcuguugcucccaacuucccuggugagcagcuccuuuucuuccgcucacaguuaccaucuucuggugggcgauccaaugggauucuagacugccuggucccccaagaauggguucagcacuucuaccaagaaucagcccccgcccaaacccagguggcucugguuagauaugucaacccugacacugguagaguguuguuugaggccaagcugcacaaauuagguuucaugacuauagcuaagaauggugacucuccaauaacuguccccccaaauggauacuuuagguuugaaucuugggugaacccauuuuauacacuugcccccaugggaacugggaaugggcguagaagaguucaauaa

SEQ ID NO: 6188 - RNA, 1623 nt, Artificial Sequence
  capsid_protein__Norovirus__AHZ12912
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaaugcuccaggugaaauauuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuucguuguucaaccacaaaauggcaggugcacgacugauggcgugcuccuagguaccacccaacuguccccugucagcaucugcaccuucagaggggaugucacccacauuccaggcagucauaacuacacaaugaauuuggccucccaaaauuggaacaguuacgacccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugcuacugacacaaacaaugauuuugaaacuaaccaaaacacaaaguucaccccagucgguguuauccaggaugguaguaccaccccccggaaugaaccccaacaaugggugcucccaaguuacucaggcagaaacauucauaaugugcacuuggcccccgcuguagcccccacuuucccgggcgagcagcuccucuucuucagaucuacuaugcccggaugcagcggguaucccaacauggauuuggacugucugcucccccaggaaugggugcaguacuucuaccaggaggcagccccagcacaaucugauguggcuuuguuaagauuugugaauccagacacagguaggguuuuguuugaguguaagcuucauaaaucaggcuauguuacaguggcucacacuggccaacaugauuugguuaucccccccaaugguuauuuuagauuugauuccuggguuaaucaguucuacacacuugcccccaugggaaacgggacggggcguagacgugcauuauaa

SEQ ID NO: 6189 - RNA, 1623 nt, Artificial Sequence
  capsid_protein__Norovirus__AHZ12913
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaaugcuccaggugaaauauuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuucguuguucaaccacaaaauggcaggugcacgacugauggcgugcuccuagguacuacccaacuguccccugucagcaucugcaccuucagaggggaugucacccacauuccaggcagucauaacuacacaaugaauuuggccucccaaaauuggaacaguuacgacccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugcuacugacacaaacaaugauuuugaaacuaaccaaaacacaaaguucaccccagucgguguuauccaggaugguaguaccaccccccggaaugaaccccaacaaugggugcucccaaguuacucaggcagaaacauucauaaugugcacuuggcccccgcuguagcccccacuuucccgggcgagcagcuccucuucuucagaucuacuaugcccggaugcagcggguaucccaacauggauuuggacugucugcucccccaggaaugggugcaguacuucuaccaggaggcagccccagcacaaucugauguggcuuuguuaagauuugugaauccagacacagguaggguuuuguuugaguguaagcuucauaaaucaggcuauguuacaguggcucacacuggccaacaugauuugguuaucccccccaaugguuauuuuagauuugauuccuggguuaaucaguucuacacacuugcccccaugggaaacgggacggggcguagacgugcauuauaa

SEQ ID NO: 6190 - RNA, 1623 nt, Artificial Sequence
  capsid_protein__Norovirus__AHZ12998
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaucugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugaucccuuuacccgauguuaggaauaauuucuaccauuauaaucaaucaaacgaccccacuaucaaauugauagcaaugcuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucauccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccucaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguugagauuugugaauccagacacagguaggguuuuguuugaguguaagcuccauaaaucgggcuauguuacaguggcucacacuggccaacaugauuugguuauuccccccaaugguuauuuuagauuugauuccugggucaaccaguucuacacacuugcccccaugggaaaugggacggggcguagacgugcauuauaa

SEQ ID NO: 6191 - RNA, 1623 nt, Artificial Sequence; identical to SEQ ID NO: 6190
  capsid_protein__Norovirus__AHZ13001

SEQ ID NO: 6192 - RNA, 1623 nt, Artificial Sequence; identical to SEQ ID NO: 6190
  capsid_protein__Norovirus__AHZ13004

SEQ ID NO: 6193 - RNA, 1623 nt, Artificial Sequence; identical to SEQ ID NO: 6190
  capsid_protein__Norovirus__AHZ13010

SEQ ID NO: 6194 - RNA, 1623 nt, Artificial Sequence; identical to SEQ ID NO: 6190
  capsid_protein__Norovirus__AHZ13015

SEQ ID NO: 6195 - RNA, 1623 nt, Artificial Sequence; identical to SEQ ID NO: 6190
  capsid_protein__Norovirus__AHZ13020

SEQ ID NO: 6196 - RNA, 1623 nt, Artificial Sequence; identical to SEQ ID NO: 6190
  capsid_protein__Norovirus__AHZ13023

SEQ ID NO: 6197 - RNA, 1545 nt, Artificial Sequence
  capsid_protein__Norovirus__AIC32559
auggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguauaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacgguaggugcacgacugauggcgugcuccuaggcaccacccaauugucuccugucaacaucugcaccuucagaggggaugucacccacaucacagguagucguaacuacacaaugaauuuggcuucucaaaauuggaacaauuaugacccaacagaagaaaucccagccccucuaggagcuccagauuuuguggggaagauucaaggcaugcucacccaaaccacaagggcagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaauguucaucuggcccccgcuguagcccccacuuuuccgggugagcaacuucucuucuuuagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuauuuuagguuugauuccugggucaaccaguucuacacgcuugcccccaugggaaauggagcggggcguagacguguaguauaa

SEQ ID NO: 6198 - RNA, 1617 nt, Artificial Sequence
  capsid_protein__Norovirus__AID51474
auggcgucgaaugacgcuacuccaucaaaugauggugcugccggccucgugccagaaaguaacaaugaggcaauggcucuggaacccguggugggggcgucuuuagccgccccugucacuggccaaacuaauauaauagaccccuggauuagaacuaauuuuguccaagccccuaauggugaauucacaguuuccccuagaaauuccccuggagagauauuggucaauuuggaguuagguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagcccuucccaaauaacaauguucccacaugugauuaucgauguuagaaccuuagaaccuguacugcucccaaugccugaugucagaagcacccuuuuccacuuuaaucaaaaggaugaaccuaagaugagacuuguugccaugcucuacaccccucuucguucuaauggcucuggugaugacguuuucacugucucauguaggauucucacuaggcccucuccugaauuugauuucacauacuuggugccaccaacaguggagucaaagaccaagccauucacacuaccugugcugacauugggagaauuguccaauucuagauucccucucucuauugaugaaauggucaccagcccuaaugaguccauaguuguucagccacagaaugguagggucacacuagauggggaguuguuaggcacaacccaacugcaagcauguaacauuuguuccauaagggggaaagugacaggacaggucccuaaugaacaacacauguggaaccuggagauuacaaaccuaaaugggacgcaauuugacccuacagaugaugucccagccccucuuggugugcccgacuuugcaggugaggucuuugguguacucagccagagaaauagaggugaaagcaauccagcaaacagggcucaugaugcuguuguggcuaccuacagugauaaauacaccccuaaauugggcuuagugcaaauugggacuuggaacaccaacgauguugaaaaccagccaacaaaauucaccccaauugguuugaaugaggucgccaauggccaucgauuugaacaguggaccuugccuagguauucuggugcccugacacuaaauaugaauuuagcuccugcuguggccccgcucuuuccuggagagcgucuccuuuucuuccgcucuuacgucccauuaaaagguggauuuggaaacccugcuauagauugucuagugccucaggaguggguccaacauuucuaucaggaaucugccccaucucugggggauguggccuuagucagguacgucaacccagacaccgggcgcguccuuuuugaggccaaacuccacaaagguggguuccugaccgugucaagcacuagcacagggccuguuguggucccagccaaugguuauuucagauuugauucuuggguuaaucaauuuuacucucuugcccccaugggaacugggaaugggcgcagaagguuucaguaa

SEQ ID NO: 6199 - RNA, 1617 nt, Artificial Sequence; identical to SEQ ID NO: 6198
  capsid_protein__Norovirus__AID51477

SEQ ID NO: 6200 - RNA, 1617 nt, Artificial Sequence; identical to SEQ ID NO: 6198
  capsid_protein__Norovirus__AID51480

SEQ ID NO: 6201 - RNA, 1617 nt, Artificial Sequence; identical to SEQ ID NO: 6198
  capsid_protein__Norovirus__AID51483

SEQ ID NO: 6202 - RNA, 1617 nt, Artificial Sequence
  capsid_protein__Norovirus__AID51486
auggcgucgaaugacgcuacuccaucaaaugauggugcugccggccucgugccagaaaguaacaaugaggcaauggcucuggaacccguggugggggcgucuuuagccgccccugucacuggccaaacuaauauaauagaccccuggauuagaacuaauuuuguccaagccccuaauggugaauucacaguuuccccuagaaauuccccuggagagauauuggucaauuuggaguuagguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagcccuucccaaauaacaauguucccacaugugauuaucgauguuagaaccuuagaaccuguacugcucccaaugccugaugucagaagcacccuuuuccacuuuaaucaaaaggaugaaccuaagaugagacuuguugccaugcucuacaccccucuucguucuaauggcucuggugaugacguuuucacugucucauguaggauucucacuaggcccucuccugaauuugauuucacauacuuggugccaccaacaguggagucaaagaccaagccauucacacuaccugugcugacauugggagaauuguccaauucuagauucccucucucuauugaugaaauggucaccagcccuaaugaguccauaguuguucagccacagaaugguagggucacacuagauggggaguuguuaggcacaacccaacugcaagcauguaacauuuguuccauaagggggaaagugacaggacaggucccuaaugaacaacacauguggaaccuggagauuacaaaccuaaaugggacgcaauuugacccuacagaugaugucccagccccucuuggugugcccgacuuugcaggugaggucuuugguguacucagccagagaaauagaggugaaagcaauccagcaaacagggcucaugaugcuguuguggcuaccuacagugauaaauacaccccuaaauugggcuuagugcaaauugggacuuggaacaccaacgauguugaaaaccagccaacaaaauucaccccaauugguuugaaugaggucgccaauggccaucgauuugaacaguggaccuugccuagguauucuggugcccugacauuaaauaugaauuuagcuccugcuguggccccgcucuuuccuggagagcgucuccuuuucuuccgcucuuacgucccauuaaaagguggauuuggaaacccugcuauagauugucuagugccucaggaguggguccaacauuucuaucaggaaucugccccaucucugggggauguggccuuagucagguacgucaacccagacaccgggcgcguccuuuuugaggccaaacuccacaaagguggguuccugaccgugucaagcacuagcacagggccuguuguggucccagccaaugguuauuucagauuugauucuuggguuaaucaauuuuacucucuugcccccaugggaacugggaaugggcgcagaagguuucaguaa

SEQ ID NO: 6203 - RNA, 1617 nt, Artificial Sequence; identical to SEQ ID NO: 6198
  capsid_protein__Norovirus__AID51489

SEQ ID NO: 6204 - RNA, 1617 nt, Artificial Sequence; identical to SEQ ID NO: 6198
  capsid_protein__Norovirus__AID51492

SEQ ID NO: 6205 - RNA, 1617 nt, Artificial Sequence
  capsid_protein__Norovirus__AID51495
auggcgucgaaugacgcuacuccaucaaaugauggugcugccggccucgugccagaaaguaacaaugaggcaauggcucuggaacccguggugggggcgucuuuagccgccccugucacuggccagacuaauauaauagaccccuggauuagaacuaauuuuguccaagccccuaauggugaauucacaguuuccccuagaaauuccccuggagagauauuggucaauuuggaguuagguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagcccuucccaaauaacaauguucccacaugugauuaucgauguuagaaccuuagaaccuguacugcucccaaugccugaugucagaagcacccuuuuccacuuuaaucaaaaggaugaaccuaagaugagacuuguugccaugcucuacaccccucuucguucuaauggcucuggugaugacguuuucacugucucauguaggauucucacuaggcccucuccugaauuugauuucacauacuuggugccaccaacaguggagucaaagaccaagccauucacacuaccugugcugacauugggagaauuguccaauucuagauucccucucucuauugaugaaauggucaccagcccuaaugaguccauaguuguucagccacagaaugguagggucacacuagauggggaguuguuaggcacaacccaacugcaagcauguaacauuuguuccauaagggggaaagugacaggacaggucccuaaugaacaacacauguggaaccuggagauuacaaaccuaaaugggacgcaauuugacccuacagaugaugucccagccccucuuggugugcccgacuuugcaggugaggucuuugguguacucagccagagaaauagaggugaaagcaauccagcaaacagggcucaugaugcuguuguggcuaccuacagugauaaauacaccccuaaauugggcuuagugcaaauugggacuuggaacaccaacgauguugaaaaccagccaacaaaauucaccccaauugguuugaaugaggucgccaauggccaucgauuugaacaguggaccuugccuagguauucuggugcccugacacuaaauaugaauuuagcuccugcuguggccccgcucuuuccuggagagcgucuccuuuucuuccgcucuuacgucccauuaaaagguggauuuggaaacccugcuauagauugucuagugccucaggaguggguccaacauuucuaucaggaaucugccccaucucugggggauguggccuuagucagguacgucaacccagacaccgggcgcguccuuuuugaggccaaacuccacaaagguggguuccugaccgugucaagcacuagcacagggccuguuguggucccagccaaugguuauuucagauuugauucuuggguuaaucaauuuuacucucuugcccccaugggaacugggaaugggcgcagaagguuucaguaa

SEQ ID NO: 6206 - RNA, 1623 nt, Artificial Sequence
  capsid_protein__Norovirus__AIE40036
augaagauggcgucgaaugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuauugaggagaugaccaauucaagauuccccauuccuuuggaaaaguuguucacgggccccagcagugccuuuguuguucaaccacaaaacggcaggugcacgacugauggcgugcuccuaggcaccacucaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguaggguucaauuugaaacugacacagaccaugauuuugaagcuaaccaaaacacaaaguucaccccaaucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcgcaggcgagcauuauaa

SEQ ID NO: 6207 - RNA, 1647 nt, Artificial Sequence
  capsid_protein__Norovirus__AJW87644
augaagauggcgucgaaugacgccgcuccaucuaaugauggugccgccggccucguaccagagaucaacaaugaggcaauggcgcuagagccaguggcgggugcagcgauagcagcaccccucacuggucagcaaaauauaauugaucccuggauuaugaauaauuuugugcaagcaccugguggugaguuuacaguauccccuagaaauucuccuggugaaguucuucuuaauuuggaauugggcccagaaauaaaucccuauuuggcccaucuugcuagaauguauaaugguuaugcagguggauuugaagugcaggugguccuagcuggaaaugcguuuacagcaggaaagauaaucuuugcagcuauucccccuaauuuuccaauugacaaucuaagugcagcacagaucacaauguguccacaugugaucguggacgucagacagcuggaaccagucaaccucccgaugccugacguucgcaacaacuucuuucauuacaaucaagggucugauucgagauugcgccuaauugcaaugcuauauacaccucuuagggcaaauaauucuggggaugauguuuuuacugugucuugcagagugcuaacuagaccuaguccugacuucucauuuaauuuccuugugccaccuacuguggagucaaagacaaaacccuuuucccucccuauucugaccaucucugaaauguccaauucgagguucccaguaccaauugauucucugcacaccagcccuacugagaacauuguuguccagugucagaaugggcgcgucacccuugauggugaguugauggguacuacccaacucuuaccuagucaaaucugugcuuucaggggcgugcucaucagaucaacaagcagggccagugaccaggccgauacagcaaccccuagauuguuuaauuauuauuggcauauacaauuggauaaucuaaauggaacuccuuaugacccugcagaagauauaccaggccccuuggggacaccagauuuccggggcaaagucuuuggcguggccagccagagaaauccugauacuacaacuagggcacaugaagcaaagauagacacaacaucuggccguuucaccccaaaauuaggcucauuggagauuuccacugaaucugaugauuuugaucaaaacaaaccaacaagauucaccccaguuggcauuggggucgaccaugaggcagacuuucaacaauggacucuucccgacuaugcuggccaguucacccacaacaugaacuuagccccagcuguugcucccaacuucccuggugagcaacuccuuuucuuccgcucacaguugccaucuucuggugggcgauccaacgggauucuagacugccuggucccucaagaauggguacagcacuucuaccaagaaucagcccccucccaaucucaaguggcccugguuagguauaucaacccugacacugguagaguguuauuugaggccaagcugcacaaauuagguuucauaacuauagccaagaauggugacucuccaauaacugucccuccaaauggauacuuuagguuugaaucuugggugaaccccuuuuauacacuugcccccaugggaacagggaaugggcguagaaggauucaauaa

SEQ ID NO: 6208 - RNA, 1623 nt, Artificial Sequence
  capsid_protein__Norovirus__ALG05457
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugagcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauagcaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcugggcacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuucaauuccagccgacgaaauucacaccagugggcgucaaugaugacgaugauggccacccguucagacaaugggaacuaccaaacuacucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauucaacacuucuaucaggaaucagcacccucccagucagacguggcccuaaucagguaugucaaccccgauacgggacguacacuguuugaagcaaaauugcacagaucugguuacauuacuguggcucauucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6209 - RNA, 1623 nt, Artificial Sequence
  capsid_protein__Norovirus__ALG05460
augaagauggcgucgaaugacgccgcuccaucuaaugauggugcugcuggucucguaccagagggcaacgacgagacccuuccccuagaaccaguugcgggcgcagccauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagacguuaggacucuugaaccaauuaugaucccacucccugauguuaggaauacauucuuccauuguaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugauguaccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuaggauuagugauaaugaugauuuccaauuccagccgacacaauucacaccagugggcgucaaugaugacgaugauggccacccguucagacaaugggaauuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaacccugauacgggacguacacuguuugaagcaaaauugcacagaucugguuacauuacuguggcucacucuggagacuauccucucguuguuccggcuaauggacacuuuagauuugauucuuggguaaaucaguuuuacucacucgccccaaugggaacugggaaugggcgaaggagggcucaguaa

SEQ ID NO: 6210 - RNA, 1623 nt, Artificial Sequence
  capsid_protein__Norovirus__ALL73873
augaagauggcgucgaaugacgccgcuccaucuaaugauggugcugcuggucucguaccagagggcaacaacgagacccuuccccuagaaccaguugcgggcgcagcuauagccgcaccugucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguagugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuuuagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6211 - RNA, 1623 nt, Artificial Sequence
  capsid_protein__Norovirus__ALL73876
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaguuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucucauuccccaagaauggauccaacacuucuaucaggaaucagcacccucucagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6212 - RNA, 1623 nt, Artificial Sequence
  capsid_protein__Norovirus__ALL73879
augaagauggcgucgaaugacgccgcuccaucuaaugauggugcugcuggucucguaccagagggcaacaacgagacccuuccccuagaaccaguugcgggcgcagcuauagccgcauccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuuaacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuacucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6213 - RNA, 1623 nt, Artificial Sequence
  capsid_protein__Norovirus__ALL73882
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccggcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcuuucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6214 - RNA, 1623 nt, Artificial Sequence
  capsid_protein__Norovirus__ALL73888
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugauuccacucccugauguuaggaauacauucuuccauuauaguaaccagccuaacagccgcaugagauuaguggcuaugcucuauaccccacucagaucuaauggcucaggugaugaugucuucacugucucuugcaggguuuugacuaggccuacuccugauuuugaguucacuuaucuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagauuauccucuuguuguuccggcuaauggacacuuuagauuugauucuuggguaaaucaguuuuacucacucgccccaaugggaacugggaaugggcgaaggagggcucaguaa

SEQ ID NO: 6215 - RNA, 1623 nt, Artificial Sequence
  capsid_protein__Norovirus__ALQ43927
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguugauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugauccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcagcuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaauguaagcuucauaaaucaggcuauguuacaguggcucacacuggccaacaugauuugguuaucccccccaaugguuauuuuagguuugauuccugggucaaccaguuuuacacgcuugcccccaugggaaacggaacggggcguagacggccacuauaa

SEQ ID NO: 6216 - RNA, 1623 nt, Artificial Sequence
  capsid_protein__Norovirus__ALQ43928
augaagauggcgucgagugacgccaacccaucugauggguccgcagccaaccucgucccagaggucaacaaugagguuauggcucuggagcccguuguaggugccgccauugcggcaccuguagcaggccaacaaaauguaauugaccccuggauuagaaauaacuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaacaaugcuggggaugaugucuucacaguuucuugccgaguucucacgagaccaucccccgauuuugauuucauauuccuagugccacccacaguugagucaagaacuaaaccauucucugucccaguuuuaacuguugaggagaugaccaauucaagguuccccauuccuuuggaaaaguuguucacgggucccagcagugccuuuguuguccaaccacaaaacgguagaugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaauuccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaacacuccuaaugugcaucuggccccugcuguagcccccacuuuuccgggugagcaacuucucuucuucagauccaccaugcccgggugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugacuugguuaucccccccaauggcuauuuuagguuugauuccugggucaaccaguuuuacacgcuugcccccaugggaaacggaacggggcguagacggccacuauaa

SEQ ID NO: 6217 - RNA, 1623 nt, Artificial Sequence
  capsid_protein__Norovirus__ALQ44123
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugauuugaacccuuauuuggcucauuugucaaggauguacaauggguaugcugguggaguggaaguucagguccuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauugguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagauuauccucuuguuguuccggcuaauggacacuuuagauuugauucuuggguaaaucaguuuuacucacucgccccaaugggaacugggaaugggcgaaggagggcucaguaa

SEQ ID NO: 6218 - RNA, 1623 nt, Artificial Sequence; identical to SEQ ID NO: 5436
  capsid_protein__Norovirus__ALQ44124

SEQ ID NO: 6219 - RNA, 1623 nt, Artificial Sequence
  capsid_protein__Norovirus__ALQ44125
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6220 - RNA, 1644 nt, Artificial Sequence
  capsid_protein__Norovirus__BAB83514
augaagauggcgucuagcgacgcugcuccaucuacggauggauccgccggucucguaccagaggucaacaaugagaccauggccuuggaaccaguggugggcgcuccucuugcugcucccguugcuggucaacauaauauuauagaccccuggauuaaaaugaauuuugugcaggcacccaauggagaauuuacuguuuccccccgcaaugccccaggugagauuuugcuagauuuggaauuaggccccgaucuuaacccuuaucuuucacauuuggcucgcauguacaaugguuacgcagguggcauggaggugcaagucguguuagccggcaaugccuucaccgcugggaagauuauuuuugccgcugucccaccgaacuuuccggcagaaaaucuuagcgcagcgcaagucaccauguguccccaugugauaguugauguuagacaauuggaaccaguuaugcucccuaugccugauauuaggaacaaauuauuucauuacaaucaaguggaugacccaaagcuuagauuacuggccuaucuuuauacgccccuucgggccaacaaugcuggggaugauguuuuuacaguuucuugucggguucuuaccagaccaaccccagacuuugaauuuauguuuuugguucccccuacuguugaaucuaaaacuaagccuuucucuuugccuagucuuacucuugaugaacuuucuaauuccagauuucccgcaccuauagugcaacuguacacaaauccccaugacaauuugguuguucagccucagaauggaagaugcaccauagauggucuccugcagggcacuacgcaacuugugucuuguaauguuugcagcuuuagggggacuauuggugauggccagccggccagccacagugaggaggagaucaugcccauggcuuucaacauccagcgagaaaucaugcuggagaaccuugauggcacacccuaugacccagcugaugacaucccugcaguauugggcucccccgauuuucagggggucauauuuggcauccuuagccagagaaacacugacgggcaaaccagggcucaugaagccaagguggacaccagggcggcucguuucgcccccaagcuugguuuugucguggccaccguagagagcacagauuuccacgccaaccaaccuaguagguucaccccuguuggguugggcggugacaacaaccaagauuucaaccaguggcgguugccggccuacggcggcgcacugacgaauaacaccaaucuugccccgcccgugaugccugucuauccaggagagcagcuucucuucuuucgcucccaacuaccaagcucugguggugugguuggcggguggcuggacugccugcucccccaggaguggguucaacacuuuuuccaggagucggccaccucucaaagcgauguggcccuagucagguauauaaaccccaccacaggcagggugcucuuugaggcaaaguuacauaaacaggguuuucucacuguggcugcuucagguuccuauccucugguuguucccgcugauggcuacuuuagauuugaaucuugggugaaucaauuuuacaccuuggcccccaugggaaaugguagugggcgcaggagagcucguuaa

SEQ ID NO: 6221 - RNA, 1644 nt, Artificial Sequence
  capsid_protein__Norovirus__BAB83516
augaagauggcgucuagcgacgccccuccaucuacggauggaucugccggucucguaccagaggucaacaaugagaccauggcccuggaaccagugguaggugccccucuugccgcacccguugcuggucaacauaauauuauagaccccuggauuaaaaugaauuuugugcaggcacccaauggagaguuuacuguuuccccccggaaugccccaggugagauuuuguuagacuuggaacuuggcccugaucuuaacccuuaucuuucacaccuggcccgcauguacaaugguuaugcgggcggcauggaagugcaaguugugcuagcugggaaugccuucaccgcuggaaaaaucaucuuugcugcugugccaccaaauuuuccagcggagaaucuuagcgcggcacagguuacuaugugcccucaugugauaguugaugugagacagcuagaaccaguuaugcuuccuaugcccgacauucggaacaagcuguuccauuauaaucaaguugaugacccaaagcuuagguuguuggccuaccuuuauacaccccuccgggcaaacaaugcuggggaugauguuuuuacaguuuccugucggguucucacuagaccaaccccagauuuugaguuuauguuuuugguuccccccacuguugagucuaaaacuaagccuuuuuccuuaccuggucuuacucuugaugaacuuucuaauucuagguuuccugcaccuauaguucagcuuuacacaaauccccaugauaacuugauugugcagccccagaauggaagauguaccauagauggucucuuacagggcacuacacagcuuguguccuguaauguuugcaguuuuagaggcacuaugggugagggccaaccagcagcccacagugaagaugaaauuaugcccauggcuuucaauguccagcgugagaucaugcuggaaaaccuugauggcucaccuuaugaccccacugaugacaucccagcgguguuggguucuccugauuuccagggggucauguuuggcauccucagccagaggaacacugacgggcaaacuagggcgcacgaggccaagguggacaccagggcagcucgcuuugccccuaaacuuggcuucguuguggcuacuguggagagcacagauuuccaugccaaccaacccagcagauuuaccccugucgggcugggcggggauaccaaucgggauuucaaccaguggcaguuaccagccuacggcggugcguugacaaacaacaccaaucucgcuccgcccgugaugccugucuacccgggagagcagcuucucuucuuccgcucccaacugccaagcuccgguggugugguugcuggauggcuggauugccugcucccccaggaguggguccaacacuucuuucaggagucggcuaccucucaaagugauguggcccuggucagguaugugaaccccaccacugguagagugcucuuugaagcgaaguugcacaaacaggguuuucucacuguggccgccucaggcuccuaucccuugguuguucccgcugaugguuauuuuagguuugagucuugggugaaccaguuuuauacuuuagcccccaugggaaauggcagcgggcgcaggcgggcucguuga

SEQ ID NO: 6222 - RNA, 1629 nt, Artificial Sequence
  capsid_protein__Norovirus__BAD72797
augaagauggcgucgaaugacgccgcuccaucuacugauggugcagccggccucgugccagaaaguaauaaugaggucauggcucuugaaccuguggcuggugccgcuuuggcagccccggucacuggucaaacaaauauuauagacccuuggauuagagcaaauuuuguccaggccccuaauggugaauuuacaguuucuccccguaaugccccuggugaagugcuguugagucuagaguuggguccagaauuaaauccuuaucuggcacacuuagcaagaauguacaacggguaugccggugggauggaggugcaggucauguuggcugggaacgcguucacagccggcaaguuggucuucgccgcugugccaccucauuucccgguugaaaaccuuaguccacagcaaauuaccauguucccucacgugauuauagauguaaggacuuuggaaccuguuuuauuaccacucccugaugugagaaauaauuucuuucauuauaaucagaaagaugaucccaaaaugagaauuguugcuaugcuuuauaccccccuuaggucuaaugguucaggugaugauguguuuacagucucuuguaggguguugacuagacccuccccugauuuugauuucacauaccuggugccaccaacaguggaauccaaaacaaaaccauuuacccuuccaauccucacacuuggggagcuuuccaauucuagauuuccaguguccauagaucagauguauacuagccccaaugaaguuauaucugugcagugucaaaauggaaggugcacacuggauggggagcuccaaggaacaacacaacuccaggucaguggcauuugugcuuucaagggagaaguuaccgcccacuugcaugacaaugaucaccuauauaaugucaccauuacaaacuugaaugggcccccuuuugaccccucugaggacauccccgccccucugggcgugccugacuuccagggaagggucuuuggugucaucucccaaagagauaaacagaaugccgcuggacacagugagccagcaaacaggggacacgaugcuguggucccuacuuacacagcacaguacacuccaaaacugggucaaguucaaauuggcacauggcagaccgacgaucuccaagucaaucaaccagucaaauuuaccccagucggccuuaaugauacugagcauuuuaaucaauggguggucccuagguaugcuggugcuuuaaaucuaaacacaaaucuugccccuucuguugcuccaguguuuccaggggagcgccugcucuuuuucagaucauauaucccccucaagggugguuauggaaacccagccauugauugucuacuaccacaggagugggugcaacauuuuuaucaggaagcagccccuucaaugagugagguggcccuugucagguacaucaacccggacacuggucgggcacuguuugaggccaagcuccauagagcugguuucgugacggucucgagcaacaccagugcuccggugguugugccugccaacggauacuucagauuugacucuuggguaaaccaauucuauucucucgcccccaugggagcuggaaaugggcguagaaggguucaguaa

SEQ ID NO: 6223 - RNA, 1647 nt, Artificial Sequence
  capsid_protein__Norovirus__BAD72798
augaagauggcgucgaaugacgcugcuccaucuaaugauggugccgccggccucgucccagagaucaacaaugaggcaauggcgcuagacccaguggcgggugcagcgauagcagcaccccucacuggucagcaaaacauaauugaucccuggauuaugaauaauuuugugcaagcaccugguggugaguuuacaguguccccuaggaauuccccuggugaagugcuucuuaauuuggaacugggcccagaaauaaacccuuauuuggcccaucuugcuagaauguauaaugguuaugcagguggauuugaagugcaggugguccuggcugggaaugcguucacagcaggaaagauaaucuuugcagcuauacccccuaauuuuccaauugauaaucugagcgcagcacaaaucacaaugugcccgcaugugauuguggaugucagacaguuggaaccggucaaccuuccgaugccugacguucgcaacaauuucuuuuauuacaaucaagggucugauucgcgauugcgcuuaauugcaaugcuguauacaccucuuagggcaaauaauucuggagaugauguuuucacugugucuuguagaguacugacuaggccuagcccugauuuuucauucaauuuccuugucccacccaccguggaaucaaagacaaaacccuuuacccucccuauucugacuaucucugaaauguccaauucuagguuuccagugccgauugagucuuugcacaccagcccaacugagaauauuguuguccagugccaaaaugggcgcgucacucucgauggugaguugaugggcaccacccaacucuuaccgagucaaauuugugcuuuuaggggcgugcucaccagaucaacaagcagggccagugaucaggccgauacagcaaccccuaggcuguuuaauuauuauuggcauguacaauuggauaaucuaaaugggaccccuuaugauccugcagaagacauaccaggcccccuagggacaccagacuuccggggcaaggucuuuggcguggccagccagagaaacccugacagcacaacuagagcacaugaagcaaagguggacacaacagcuggucguuucaccccaaaguugggcucauuagaaauaucuacugaguccagugacuuugaccaaaaccaaccaacaagauucaccccaguuggcauugggguugacaaugaggcagauuuucaacaauggucuuuacccgacuauucuggucaguucacccacaacaugaacuuggccccagcuguugcucccaacuucccuggugagcagcuccuuuucuuccgcucacaguuaccaucuucuggugggcgauccaacgggguccuagacugucuggucccccaggaauggguccaacacuucuaccaggaaucggcccccgcccaaacacaaguggcccugguuagguaugucaacccugacacugguagagugcuauuuggggccaagcugcauaaauuagguuuuaugacuauagcuaagaauggugauucuccaauaacuguucccccaaauggauauuuuagguuugaaucuugggugaaccccuuuuauacacuugcccccaugggaacugggaaugggcguagaaggauucaauaa

SEQ ID NO: 6224 - RNA, 1647 nt, Artificial Sequence
  capsid_protein__Norovirus__BAD72799
augaagauggcgucgaaugacgccgcuccaucuaaugauggugcagccggccucgugccagaaaguaacaaugagguuauggcucuugaaccuguugcuggggcaucuuuagcugccccugugacuggucaaacuaauauaauugacccauggauuagaaugaauuuuguucaagccccaaauggagaauucacuguuuccccaagaaauuccccuggagaaguacuccuaaauuuggaauuggguccugaauuaaacccuuaucuggcacaccuaucuaggauguauaauggcuaugcuggggguauggaaguacagaucaugcuagcugggaacgcguucacugcugguaaacugaucuuugcugcugugcccccacauuuucccauugaaaauuugagucccccccagauuacaauguucccacaugugauuauagauguuagaacuuuagaaccuguguugcucccuaugccugacaucaggaauucuuucuuucacuuuauccagagggaugagccaaagaugagguugguggcaaugcuguacacgccacugagguccaacggaucuggggaugauguauucacagucuccugcaggguucugacccgcccuacuccugauuucgauuucacuuacuuaguaccaccaacugucgagucaaagaguaagccuuucacuuuaccuauauuaacauugggagaguugacaaauucuagguuuccauuacccauugauguccuguauacuaauccaaaugaaagugcaauuguucaaugucagaaugguaggugcacccugggcggcgaguugcaggggacggcucaacuccuacccacaggcaucugugcguucaggggcaaagucacucaacaggugcaggaugaacaucggggcacacauuggaauaugacaguaaccaaauuaaaugguaccccguuugacccaacugaggaugucccugcuccacugggcaccccggauuucuccggccaaauuuauggggugauuagucagaggaauaccaacacaguucccggugagggaaaccucccggccaacagggcucacgaggcagugauugcaaccuacagucccaaauucacacccaaauugggcaauauucaauucagcacuugggaaacucaagaugugagcucuggacaacccaccaaguucaccccaguuggcuuggccuccguggaugcuaacucccauuuugaccaauggacccuccccagcuauucuggugcccuaacucuaaauaugaacuuggccccaucugucgccccaguuuucccuggagagugucuuuuguucuuuagaucuuucaucccauuaaaggggggcuaugggaacccugcuauugauugcuugaugccacaggaauggguccagcaucucuaccaggagucggcaccaucccuuagugauguggcuuuagugagguaugugaacccagaaacugggcgcacccuuuuugaagccaaguugcacaggaauggauuucugacuguugcuaggaacagugcuggaccugucguggcccccacaaaugguuauuuuagauuugauucuuggguuaaccaauuuuacacuuuagcccccaugggaaaugguagugggcguagaaggauucaguaa

SEQ ID NO: 6225 - RNA, 1623 nt, Artificial Sequence
  capsid_protein__Norovirus__BAD72800
augaagauggcgucgaaugacgccgcuccaucuaaugauggugcagccggucucguaccagaggucaacaacgagacaauggcacuugagccaguugcgggagcuucaaucgccgccccucuaacuggucaaaacaauguaauagaccccuggauuagauuaaauuuuguacaagccccuaacggugaguucacgguuuccccccgaaacucgccuggugaaauuuuguuaaauuuggaguuagggccugaauugaacccauauuuagcccauuuagcaagaauguauaaugguuaugcaggugggguugaggugcaggugcugcuggcuggaaaugcguuuacagcgggcaaauugguauucgcagcaauccccccccauuucccaguagauaauuugagcccuggucagauuaccauguuuccccaugugauuauugauguuaggacacuugaaccuguuuuauuaccauuaccugacguuaggaauaauuucuuccauuacaaucaacagagugaucagcgcaugagacuuauugcuaugcuuuacaccccucuuagaucuaaugguucaggugaugauguuuucacugugucaugcaggguuuuaaccaggccauccccugauuuucauuuucacuauuugguucccccaacaguugaauccaaaacuaaacccuucucaguuccagugcugacccucaaugagcugaccaacucucgcuuucccgucccgauugaugccauguacaccagcccuaacgauucaauugugguccaaccucagaaugggagggcaaccauagacggugaguugcuuggcacuacucaacucauccccagugguaucugcucauuuagaggaaaaauuacaacacauuuggcagaugauaggcacuuguggaauauccaagucuccaacuugaauggcacuccguuugauccaacggacgacgugccugcaccauugggcaugccagacuuuucugggcaaauauuuggggugguuagugaaagggacacaggcaccaaccccgcaaacagggcucaugaugcuguccucgcaaccuacagugcuaaauauacuccuaagcucggaucaguccaaauuggaacuugggacaccgaggauuuacuugaaagacagccuguuaaauuuacacccguuggccucaaugaaauuggacaagacaagcacuuugaccaaugggucuugccaaauuauucuggugcccuaggacucaacaugcaccuggcuccugcuguguccccacucuucccaggggagaggcugcuguucuuuagaucauacauaccucuaaaagguggccauggggacccauuuauugauugucuugugccucaagaauggauacaacauuuuuaucaagagucagccccagcacaauccucgguggcucugcugagguaugugaauccagacacaggucguacccuguuugaagccaaauuacacaaggaaggguuuaucaccgucucuaguacggaaaacaggccugugauuguccccccaaaugguuacuuuagguucgauucuuggguuaaccaauucuauucauuagcccccaugggaacuggcaaugggcguagaaggauucaguaa

SEQ ID NO: 6226 - RNA, 1620 nt, Artificial Sequence
  capsid_protein__Norovirus__BAD88558
augaagauggcgucgaaugacgucaacccaucugauggguccgcagccaaccucgucccagaggucaacaaugagguuauggcucuggagcccguuguuggugccgccauugcggcaccuguggcgggccaacaaaacauaauugaccccuggauuagaaauaauuuuguacaagccccugguggagaauucacaguguccccuaggaaugcuccaggugaaauacuauggagcgcaccuuugggcccugauuugaaccccuaccuuucucauuugucuagaauguauaaugguuaugcaggugguuuugaagugcaagugauccucgcggggaacgcguucaccgcugggaaggucauauuugcggcagucccuccaaacuucccaacugaaggucugagcccuagucaaguuacuauguucccccauauaauuguagauguuagacaauuagaaccuguguugaucccccuacccgauguuaggaauaacuuuuaccauuacaaucaggcacaugauucuacccucaaguugauagcaaugcuguacacaccacuuagagcuaauaaugccggggaugacguguucacagucucuugccgaguucucacgaggccaucccccgauuuugauuuuauauuucuggugccacccacaguugaaucaagaacuaaaucauuuacugucccagucuugaccgucgaggaaaugacuaauucaagauuccccauuccuuuggaaaagcuuuacacgggcccuaguagugccuuuguuguucaaccacaaaauggcagaugcacgacugacgguguguuacugggcacuacccagcugucagcugucaauaucugcaccuucaggggggacgucacccauauugcgggcagccgcaacuacacaaugaauuuggcaucccaaaacuggaacaauuaugacccaacagaagaaaucccagccccccugggaauaccagacuuugugggaaagauccaaggcuugcucacccagaccacaagagcggacgguucgacucgugcccacaaggccacagugagcacugggaguguccacuucaccccaaagcuggguaguguucaauucuccacugacacagacaaugacuuccagccuggccaaaauacaaaguucaccccaguuggcgucauccaagacggcgaccgccaccaaaacgaaccccagcaaugggugcucccagauuacucaggcagaacuggccacaacgugcaccuggccccugcuguugcccccacuuuccccggugagcagcuucuuuucuuuagguccaccaugccaggauguaguggguaucccaacaugaaucuggauugcuuacucccucaggaauggguguugcacuuuuaucaggaaucagccccagcacaauccgauguggccuugcuaagauuugugaauccggacacaaacaggguccuguuugagugcaagcuucauaaaucaggcuauauuacaguggcccacaccggccagcaugauuugauucucccccccaaugguuauuuuagauuugauucuugggucaaucaauucuacacacucgcccccaugggaaauggagcggggcgcaggcgugcaccauaa

SEQ ID NO: 6227 - RNA, 1623 nt, Artificial Sequence
  capsid_protein__Norovirus__BAD98240
augaagauggcgucgaaugacgcuacuccaucaaaugauggugcugccggccucgugccagaaaguaacaaugaggcaauggcucuggaacccguggugggggcgucuuuagccgccccugucacuggccaaacuaauauaauagaccccuggauuagaacuaauuuuguccaagccccuaauggugaauucacaguuuccccuagaaauuccccuggagagauauuggucaauuuggaguuggguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagcccuucccaaauaacaauguucccacaugugauuaucgauguuagaaccuuagaaccuguacugcucccaaugccugauguuagaagcacccuuuuucacuucaaucaaaaggaugaaccuaagaugagacuuguugccaugcuuuacaccccucuucguucuaauggcucuggugaugacguuuucacugucucauguaggauccucacuaggcccuccccugaauuugauuucacauacuuggugccgccaacaguggaaucaaagaccaagccauucacacuaccugugcugacacugggagaacuguccaacucuagauucccucucucuauugaugaaauggucaccagcccuaaugaguccauaguuguucagccacagaaugguagggucacacuagauggggagcuguuaggcacaacccaacugcaagcauguaacauuugcuccauaagggggaaagugacaggacaggucccuaaugaacaacacauguggaaccuggagauuacaaaccuaaaugggacgcaauuugacccuacagaugaugucccagccccucuuggugugcccgacuuugcaggugaggucuuugguguacucagccagagaaauagaggugaaagcaacccagcaaacagggcucaugaugcugucguggcuaccuacagugauaaauacaccccuaaauugggcuuagugcaaauugggacuuggaacaccaacgauguugaaaaccagccaacaaaauucaccccaauugguuugaaugaggucgccaauggccaucgauuugaacaguggacuuugccuagguauucuggugcccugacacuaaauaugaauuuagcuccugcuguggccccacucuuuccuggagagcgucuccuuuucuuccgcucuuacgucccauuaaaagguggauuuggaaacccugcuauagauugucuagugccucaggaguggguccaacauuucuaucaggagucugccccaucucugggggauguggccuuagucagguacgucaacccagacaccgggcgcguccuuuuugaggccaaacuccacaaagguggguuccugaccgugucaagcacuagcacagggccuguuguggucccagccaauggcuauuucagauuugauuccuggguuaaucaauuuuacucucuugcccccaugggaacugggaaugggcgcagaagguuucaguaa

SEQ ID NO: 6228 - RNA, 1632 nt, Artificial Sequence
  capsid_protein__Norovirus__BAE43833
augaugauggcgucuaaggacgccccaacaaacauggauggcaccaguggugcuggucagcugguuccagaggcaaguacagcugaaccuauaucaauggagccuguggcuggugcugcuacagcagcagcaaccgcaggucaaguuaauaugauugaccccuggauuaugaguaauuauguucaagccccucaaggagaguucacaauuuccccuaacaacacucccggagauauauuguuugauuuacaauuagggccccauuugaacccauuccuaucacaccuggcccagauguacaauggauggguugguaauaugaaaguuagggugcugcucgcugguaaugccuucacagcggguaaaauaauaauuaguuguguucccccugguuuugcagcccaaaaugucucaauagcccaagcaacaauguuuccccacguuauugcagaugugagagugcuugaaccaauugaaguuccauuagaggaugugaggaaugugcucuuccacaauaaugacuccacuccaacuaugagauugauuuguauguuguauaccccucuccgugcuaguggcagcuccucuggcacugauccauuugucauagcuggacggguccucaccugucccaguccugacuuuaacuuuuuguuucuugugccccccaauguugagcagaaaacuaaaccauuuaguguaccuaaucucccccucaauguucucucaaauucuaggguucccucuuugauaaagucuaugauggucucccaagaccaugggcagauggugcacuuccagauugggagggucacauuagauggacagcuccaagguaccacucccacuucagcuagucagcucugcaaaauucgagggacgguuuaccaugcaacugguggccaagggcuuaauuugacugagauugaugggacucccuaccaugcauuugagagccccgccccaauugguuuccccgauuugggugagugugauuggcauauuaacgcaucuccugcuaaugcuuucacagaugguaguaucauacacagaauugauguggcccaggauuccacuuuugcuccccaucuaggcacuauccacuauaccaacgcuaacuaugaugccaauguuagccuaauuuguucacuugaauggcucucccccccaagcgggggugcuccaaagguuaacccaugggcuauuccucgauacgguucaacccugacugaggcugcccaguuggccccaccaauauacccucccggauuuggcgaggcaauugucuucuuuaugucugauuuccccauagcuaaugguucagaugguuugagugucccuugcacuauaccacaagaguuugugacccauuuuguuaaugaacaagcacccacucguggugaggcugcacuguugcacuauguugacccugacacacaucgcaauuugggcgaauucaaauuauacccugaagguuuuaugacuuguguccccaacuccagugguaguggaccccagacacugccuaucaaugggguuuucacuuucauuuccuggguuucucgcuucuaucaauuaaagccugugggaacgaccgguccgguccguaggcuaggcauucggaggucauaa

SEQ ID NO: 6229 - RNA, 1647 nt, Artificial Sequence
  capsid_protein__Norovirus__BAE48588
augaagauggcgucgaaugacgccacuccaucuaaugauggugccgccggccucgucccagagaucaacaaugaggcaauggcgcuagacccaguggcgggugcagcgauagcagcaccccucacuggucagcaaaauauaauugaucccuggauuaugaauaauuuugugcaagcaccugguggugaguuuacaguauccccuaggaauuccccuggugaagugcuucucaauuuggaauuggguccagaaauaaaucccuauuuggcccaucuugcuagaauguauaaugguuaugcagguggauuugaagugcagguaguccuagcuggaaaugcguuuacagcaagaaagauaaucuuugcagcuauacccccuaauuuuccaauugauaauuuaagcgcagcacauaucacaaugugcccacaugugauuguggaugucagacaguuggaaccggucaaccucccgaugccugacguucgcaacaacuucuuucauuacaaucaagggucugauucgagauugcgcuuaauugcaaugcuguauacaccucuuagggcaaauaauucuggggaugauguuuucacugugucuuguagagugcugacuaggccuagcccugacuuuucauuuaauuuccuugugccaccuaccuuggagucaaagacaaagcccuucacccucccuauucugacuaucucugaaauguccaauucuagguuuccagugccgauugauucuuugcacaccagcccaacugagaauauuguuguccagugccaaaaugggcgcgucacucuugauggugaguugaugggcaccacccaacucuuaccuagucaaaucugugcuuuuaggggcgugcucaccagaucaacaagcagggccagggaucaggccgacacagcaaccccuagguuguuuaauuauuauuggcacauacaauuggauaaucuaaaugggacuccuuaugauccugcagaagacauaccaggcccccuagggacaccagauuuccggggcaaagucuuuggcguggccagccagagaaaucccgacagcacaacuagagcacaugaagcaaagguggacacaacagcuggucguuucaccccaaaacuaggcucauuagagauauccacugaaucugaugacuuugaucaaaaccaaccaacaagauucaccccaguuggcauugggguugacaaugaggcagacuuucaacaauggucuuuacccgacuauucuggucaguucacccacaacaugaacuuagccccagcuguugcucccaacuucccuggugagcagcuccuuuucuuccgcucacaguuaccauccucuggugggcgauccaacgggauucuagacugccuggucccccaagaauggguucagcacuucuaccaagaaucggcucccucucaaacucaaguggcccugguuagguaugucaacccugacacugguagaguauuauuugaagccaagcugcacaaauuagguuucacgaccauagcuaagaauggugacucuccaauaacugucccuccaaauggauacuuuagguuugaaucuugggugaaccccuuuuauacacuugcccccaugggaacugggaaugggcguagaaggaaucaauaa

SEQ ID NO: 6230 - RNA, 1647 nt, Artificial Sequence
  capsid_protein__Norovirus__BAE48589
augaagauggcgucgaaugacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaacuuugugcaagcaccugguggugaguuuacaguauccccuaggaauuccccuggugaagugcuucuuaauuuggaauugggcccagaaauaaaucccuauuuggcccaucuugcuagaauguauaaugguuaugcagguggguuugaagugcagguaguccuagcuggaaaugcguuuacagcaggaaagauaaucuuugcagcuauacccccuuauuuuccaauugauaauuuaagcgcagcacagaucacaaugugcccacaugugauuguggaugucagacaguuggaaccggucaaccucccgaugccugacguucgcaauaacuucuuucauuauaaucaagggucugauucgagauugcgcuuaguugcaaugcuguauacaccucuuagggcaaauaauucuggggaugauguuuuuacugugucuuugagagugcugacuaggccuagcccugacuuuucauuuaauuuccuugugccaccuacuguggagucaaagacaaaacccuuuacccucccuauucugacuaucucugaaauguccaauucuagguuuccagugccgauugauucucugcacaccagcccaacugagaauauuguuguccagugccaaaaugggcgcgucacucuugauggugaguugaugggcaccacccaacucuuaccuagucagaucugugcuuucaggggcgugcucaccagaucaacaagcagggccagugaccaggccgacacagcaaccccuagguuguuuaauuauuauuggcacauacaauuggauaaucuaaacgggacuccuuaugauccugcagaagacauaccaggcccccuagggacaccagauuuccggggcaaagucuuuggcguggccagccagagaaaucccgacagcacaacuagagcacaugaagcaaagguggacacaacagcuggucguuuuaccccaaaacuaggcucauuagagauauccacugaaucugaugacuuugaucaaaaccaaccaacaagauucaccccaguuggcauugggguugaccacgaggcagauuuccaacaauggucuuuacccgacuauucuggucaguucacccacaacaugaacuuagccccagcuguugcucccaacuucccuggugagcagcuccuuuucuuccgcucacaguuaccauccucuggugggcgauccaacgggauucuagacugccuggucccccaagaauggguucagcacuucuaccaagaaucggcccccgcccaaacucaaguggcccugguuagguaugucaacccugacacugguagaguauuguuugaggccaagcugcacaaauuagguuucaugacuauagcuaagaauggugacucuccaauaacuguccccccaaauggauauuuuagguuugaaucuugggugaacccauuuuauacacuugcccccaugggaacugggaaugggcguagaaggauucaauaa

SEQ ID NO: 6231 - RNA, 1647 nt, Artificial Sequence
  capsid_protein__Norovirus__BAE48590
augaagauggcgucgaaugacgccacuccaucuaaugauggugccgccggccucgucccagagaucaacaaugaggcaauggcgcuagauccaguggcgggugcagcuauagcagcaccccucacuggccagcaaaauauaauugaucccuggauuaugaauaauuuugugcaagcaccugguggugaguuuacaguauccccuaggaauuccccuggugaagugcuucuugauuuggaauuggguccagaaauaaaucccuauuuggcccaucuugcuagaauguauaaugguuaugcagguggauuugaagugcagguaguccuagcugggaaugcguucacagcaggaaagauaaucuuugcagcuauacccccuaauuuuccaauugauaaucuaagcgcagcacagaucacaaugugcccacaugugauuguggaugucagacaguuggaaccggucaaccucccgaugccugacguucgcaacacuuucuuucauuacaaucaagggucugauucgagauugcgcuuaauugcaaugcuguauacaccucuuagggcaaauaauucuggggaugauguuuuuacugugucuuguagagugcugacuaggccuagcccugacuuuucauuuaauuuccuugugccacccacuguggagucaaagacaaaacccuucacccucccuauucugacuaucucugaaauguccaauucuagguuuccagugccgauugauucucugcacaccagcccaaccgagaguauuguuguccagugccaaaauggacgcgucacucuugauggugaguugaugggcaccacccaacucuuaccuagucaaaucugugcuuuuaggggcgugcucaccagaucaacaagcagggccagugaccaggccgacacagcaacccccagguuguuuaauuauuauuggcacauacaauuggauaaucuaaaugggacuccuuaugauccugcagaagacauaccaggcccccuagggacaccagacuuccggggcaaagucuuuggcguggccagccagagaaacccggacagcacaacuagagcacaugaggcaaagguggacacaacaacuggucguuucaccccaaaacuaggcucauuagagauauccacugaaucugaugacuuugaucaaaaccaaccaacaagauucaccccaguuggcauugggguugaccaugaggcagacuuucaacaauggucuuuacccgauuauucuggucaguucacccacaacaugaacuuagccccagcuguugcuccuaacuuccguggugagcagcuccuuuucuuccgcucacaguuaccauccucuggugggcgauccaacgggacccuagacugccuggucccccaagaauggguucagcacuucuaccaagaaucggcccccgcccaaacucaaguggcccuggucagguaugucaacccugacacuggcagaguauuauuugaggccaagcugcacaaauuagguuucaugacuauagcuaagaauggugacucuccaauaacugucccuccaaauggauauuuuagguuugaaucuugggugaaccccuuuuauacacuugcccccaugggaacugggaaugggcguagaaggauucaauaa

SEQ ID NO: 6232 - RNA, 1644 nt, Artificial Sequence
  capsid_protein__Norovirus__BAE92970
augaagauggcgucuaaugacgcuuccccaucuacggauggauccgccggucucguaccagaggucaacaaugagaccauggccuuagaaccaguggugggugcuccucuugcugcucccgucgcuggucagcauaauauuauagaccccuggauuaagaugaauuuugugcaggcaccuaauggagaauuuacuguuuccccccguaaugccccaggugaaauuuugcuagauuuggaacuuggcccugaccuuaaucccuaccuuucacauuuggcgcgcauguauaaugguuaugcaggugguauggagguacaaguuguauuggcugguaacgccuuuacugcuggcaaaaucaucuucgcugcugucccaccaaauuucccagcggagaaccucagcgcagcgcaggucaccaugugcccccaugugauaguugauguuagacaauuggaaccaguuaugcuccccaugccugauauuaggaauaaguuguuccauuacaaucaaguugaugacccaaagcuuagauugcuggcuuaccuuuauacaccccuccgagccaacaacgccggagaugauguuuuuacaguuuccugccggguucuuacuagaccaaccccagauuuugaguuuauguuuuuggucccccccacuguugaaucuaaaacuaagccuuuuucucugcccagccucaccuuggaugaacuuucuaauucuagauuccccgcgcccauagugcagcuuuacacuaauccccaugacaauuugguugugcaaccccagaauggaagguguacuauagauggucuuuugcagggcacuacacaacuuguguccugcaacguuugcaguuucaggggaacccuuggugauggccaaccagcgagccacagugaggaggagauuaugcccauggcuuuuaauguucaacgugagaucaugcuggaaaaucuugauggcucacccuaugacccaacugaugacauccccgcggugcugggcuccccugauuuucaagggguuguguuuggcauucucagccagaggaacacugacgggcaaaccagggcacaugaggccaagguggacaccagggcggcccguuucgccccuaagcuuggcuuugucguggccacuguggagagcacagauuuccacgccaaucaaccuagcagguucaccccuguuggauuggguggagacggcaaccaggauuucaaccaguggaguuugccagccuaugguggcgcacugacaaacaacacaaaucuugcuccgcccgcaaugcccguuuacccaggggagcagcuucucuucuuccgcucucagcugccgagcucagguggcgugguugguggguggcuggauugccuucuuccccaggaguggguccagcacuuuuuccaggagucagccacuucccagagugacguggcucuagucagguacauaaaccccaccacuggcagaguguuguuugaggcaaaacuacacaaacaggguuuucucaccguggcugccucagguucuuaccccuuaguuguuccugcugaugguuauuuuagguuugagucuugggugaaucaguuuuacacuuuggcccccaugggaaaugguagcgggcgcaggagcgcucguuga

SEQ ID NO: 6233 - RNA, 1623 nt, Artificial Sequence
  capsid_protein__Norovirus__BAE98191
augaagauggcgucgaaugacgccagcccaucugauggguccacagccaaccucgucccagaggucaacaaugagguuauggcuuuggagcccguuguuggugccgccauugcggcaccuguagcgggccaacaaaauguaauugaccccuggauuaggacuaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucaucuuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaacgacuccaccauuaaauugauagcaaugcuguacacaccacuuagggcuaauaaugcuggggaugaugucuucacagucucuugucgaguccucacgaggccaucccccgauuuugauuuuauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccagcugucccccgucaacaucugcaccuucagaggcgaugucauccacauuccagguacucguacuuacagaaugaauuuggcuucucaaaauuggaacaauuaugacccaacagaagaaaucccagccccucugggaaccccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucacaauguacaccuagccccugccguagcccccacuuuuccaggugagcaacuucuuuucuucagaucuacuaugcccggaugcaguggguaucccaauauggauuuggauugucuacucccccaggaaugggugcagcacuucuaccaagaggcagccccaucacaaucugauguggcuuugcugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 6234 - RNA, 1623 nt, Artificial Sequence
  capsid_protein__Norovirus__BAE98194
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaacccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccauuacaaccaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaaggaccaaaccauucaccgucccaauuuuaacuguugaggaaaugaccaauucaagauuccccauuccuuuggaaaaauuguucacgggucccagcagugccuuugucguccaaccacaaaauggcagaugcacgacugauggcgugcucuuaggcacuacccaacugucccccgucaacaucugcacuuucagaggcgaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguggcccccacuuuuccgggugagcaacuucuuuucuucagaucuacuaugcccggaugcagugguuaucccaauauggauuuggauugucuacucccccaggaaugggugcagcacuucuaccaagaggcagccccaucacaaucugacguggcuuugcugagauuugugaauccagacacagguaggguucuguuugagugcaagcuucauaaagcaggcuaugucacaguggcucacacuggccagcaugauuugguuaucccccccaaugguuacuuuagauuugauuccugggucaaccaguucuacacacuugcccccaugggaaauggagcggggcguagacgugcauuauaa

SEQ ID NO: 6235 - RNA, 1623 nt, Artificial Sequence
  capsid_protein__Norovirus__BAE98197
augaagauggcgucgaaugacgccagcccaucugauggguccacagccaaccucguuccagaggucaacaaugagguuauggcuuuggagcccguuguuggugccgcuauugcggcaccuguagcgggccaacaaaauguaauugaccccuggauuaggaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuugacuguugaggaaaugaccaauucaagauuccccauuccuuuggaaaaauuguucacgggucccaguagugccuuugucguccaaccacaaaauggcaggugcacgacugauggcgugcucuuaggcacuacccaacugucccccgucaacaucugcaccuucagaggcgaugucacccacauuucagguacccguacuuacagaaugaauuuggcuucucaaaauuggaacaauuaugacccaacagaagagaucccagccccucuggggacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacuguucacaauguacaccuggccccugccguagcccccacuuuuccgggugagcaacuucuuuucuucagaucuacuaugcccggaugcaguggguaucccaauauggauuuggauugucuacucccccaagaaugggugcagcacuucuaccaagaggcagccccaucacaaucugauguggcuuuguugagauuugugaauccagacacagguaggguuuuguuugagugcaagcuucauaaagcaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6236 - RNA, 1623 nt, Artificial Sequence
  capsid_protein__Norovirus__BAF45861
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaacgggcaugcaggugguuuugaagugcaggugauccucgcggggaacgcguucaccgccggaaaaauuauauuugcagcagucccaccaaauuucccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucugaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccugggucaaucaauucuacacacuugcccccaugggaaauggaacggggcgcaggcgugcuuuauaa

SEQ ID NO: 6237 - RNA, 1620 nt, Artificial Sequence
  capsid_protein__Norovirus__BAF74508
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaguaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagaugucaggcaauuggaaccuguguugauccccuuaccugauguuaggaacaauuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaaaauccaaggcgugcucacccaaaccacaagaggggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacggugauaaccaucaaaaugaaccccaacaaugggugcucccaaauuacucagguagaacuggucauaaugugcacuuagccccugccguugcccccacuuucccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguucuguuugagugcaagcuccauaagucaggcuaugucacaguggcucacacuggcccgcaugauuugguuaucccccccaaugguuacuuuagauuugauuccugggucaaccaguucuacacacuugcccccaugggaaauggagcggggcguagacgcgcauuauaa

SEQ ID NO: 6238 - RNA, 1620 nt, Artificial Sequence
  capsid_protein__Norovirus__BAF74509
augaagauggcgucgaaugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaauaauuuugugcaagccccugguggagaguuuacaguauccccuagaaacgcuccgggugagauccuuuggagcgcgcccuugggcccugauuugaaccccuaccuuucucauuuggccagaauguacaaugguuaugcaggugguuuugaagugcagguaauccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaauuucuaucauuauaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguacacgggucccagcagcgcuuuuguuguccaaccacaaaauggcaggugcacaacugauggcgugcucuuaggcacuacccagcuguccgcugucaacaucugcaccuucagaggggaugucacccacauugcgggcagucaugauuauacaaugaauuuggcuucucaaaauuggaacaauuaugacccaacagaagagaucccagccccucugggaacuccagacuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauuuaccccagucggcgucauccaggacgguaauaaccaucaaaaugaaccccaacaauggguacucccaaauuauucagguagaacuggucacaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguuuuguuugagugcaagcuccauaaaucaggcuauguuacaguggcucacacuggcccgcaugauuugguuaucccccccaaugguuacuuuagauuugauuccugggucaaccaguucuacacacuugcccccaugggaaauggagcggggcguagacgcgcauuauaa

SEQ ID NO: 6239 - RNA, 1620 nt, Artificial Sequence
  capsid_protein__Norovirus__BAF74510
augaagauggcgucgaaugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaauaauuuugugcaagccccugguggagaguuuacaguguccccuagaaacgcuccgggugagauccuuuggagcgcgcccuugggcccugauuugaaccccuaccuuucucauuuggccagaauguacaaugguuaugcaggugguuuugaagugcagguaauccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugaucccuuuaccugauguuaggaauaauuucuaucauuauaaucaaucaaaugauucuaccauuaaauugauagcaaugcuguauacaccacuuagggcuaauaaugcuggggaugaugucuucacagucuuuuguagaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguacacgggucccagcagcgcuuuuguuguccaaccacaaaauggcaggugcacaacugauggcgugcucuuaggcacuacccagcugucugcugucaacaucugcaccuucagaggggaugucacccacauugcgggcagucaugauuauacaaugaauuuggcuucucaaaauuggaacaauuaugacccaacagaagagaucccagccccucugggaacuccagacuucgugggaaagauccaaggcaugcucacccaaaccacaagagaggauggcucgacccgcgcccacaaagcuacagugagcacugggaguguccacuuuacuccaaagcugggcaguguucaauacaccacugauacaaacaaugauuuucaaacuggccaaaacacgaaauuuaccccagucggcgucauccaggacgguaauaaccaucaaaaugaaccccaacaauggguacucccaaauuauucagguagaacuggucacaaugugcaccuagcuccugccguugcccccacuuuuccgggugagcagcuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguuuuguuugagugcaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacgcgcauuauaa

SEQ ID NO: 6240 - RNA, 1620 nt, Artificial Sequence
  capsid_protein__Norovirus__BAF74511
augaagauggcgucgaaugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaauaauuuugugcaagccccugguggagaguuuacaguauccccuagaaacgcuccgggugagauccuauggagcgcgcccuugggcccugauuugaaccccuaccuuucucauuuggccagaauguacaaugguuaugcaggugguuuugaagugcagguaauccucgcggggaaugcguucaccgccgggaaaaucauauucgcagcagucccaccaaauuuuccaacugaaggcuugagccccagccaggucacuauguucccccauauaauaguagauguuaggcaauuggaaccuguguugauccccuuaccugauguuaggaacaauuucuaccauuauaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguucacgggucccagcagcgcuuuuguuguccaaccacaaaauggcaggugcacaacugauggcgugcucuuaggcacuacccagcugucugcugucaacaucugcaccuucagaggggaugucacccacauugcgggcagucaugauuauacaaugaauuuggcuucucaaaauuggaacaauuaugacccaacagaagagaucccagccccucugggaacuccagacuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauuuaccccagucggcgucauccaggacgguaauaaccaucaaaaugaaccccaacaaugggugcucccaaauuauucagguagaacuggucacaaugugcaccuagcuccugccguugcccccacuuuuccgggugagcaacuucuuuucuuuagguccacuaugcccggauguagcggguaucccaacauggaucuggauugccuacucccccaggaaugggugcagcacuucuaccaagaagcagcuccagcacaaucugauguggcucugcugagauuugugaauccagacacagguaggguuuuguuugagugcaagcuccauaaaucaggcuaugucacaguggcucacacuggcccgcaugauuugguuauccccccuaaugguuacuuuagauuugauuccuggaucaaccaguucuacacacuugcccccaugggaaauggagcggggcgcaggcgugcauuauaa

SEQ ID NO: 6241 - RNA, 1620 nt, Artificial Sequence
  capsid_protein__Norovirus__BAF74512
augaagauggcgucgaaugacgccaccccaucugauggguccacagccaaccucgucccagaggucaacaaugaggucauggcuuuggagcccguuguuggugccgcuauugcggcacguguagcgggccaacaaaauguaauugaccccuggauuagaaauaauuuuguacaagccccugguggagaguuuacaguguccccuagaaacgcuccgggugagauacuauggagcgcgcccuugggcccugaucugaaccccuaccuuucccauuuggccagaauguacaaugguuaugcaggugguuuugaagugcagguaauccucgcggggaacgcguucaccgccgggaaaaucauauuugcagcagucccaccaaauuuuccaacugaaggcuugagccccagccaggucacuauguucccccauauaauaguagauguuaggcaauuggaaccugugcugauccccuuaccugauguuaggaauaauuucuaucauuacaaucaaucaaaugauucuaccauuaaauugauagcaaugcuguauacaccacuuagggcuaauaaugcuggggaugaugucuucacagucucuugucgaguccucacgaggccaucccccgacuuugacuucauauucuuggugccacccacaguugaaucaagaacuaaaccauucaccgucccaaucuuaacuguugaggaaauguccaauucaagauuccccguuccuuuggaaaaguuguacacgggucccagcagugcuuuuguuguccaaccacaaaauggcaggugcacgacugauggcgugcucuuaggcaccacccagcugucugcugucaacaucugcaccuucagaggggaugucacccacauugcaggcagucaugauuauacaaugaauuuggcuucucaaaauuggaacaauuaugacccaacagaagaaaucccagccccucugggaaccccagauuucgugggaaagauccaaggcgugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacgguaguaaccaucaaaaugaaccccaacaaugggugcucccaaacuacucagguagaacuggccauaaugugcacuuagccccugccguugcccccacuuuuccgggugagcaacuucuuuucuuuagguccacuaugcccggauguagcggguaucccaauaugaaucuggauugccuacucccccaggaaugggugcagcacuucuaccaagaagcagcuccagcacaaucugauguggcucugcugagauuugugaauccagacacagguaggguucuguuugagugcaaacuccauaaaucaggcuaugucacaguggcucacacuggcccgcaugauuugguuaucccccccaaugguuauuuuagauuugauucuugggucaaucaguucuacacacuugccccuaugggaaauggagcggggcguagcagugcauuauaa

SEQ ID NO: 6242 - RNA, 1620 nt, Artificial Sequence
  capsid_protein__Norovirus__BAF74513
augaagauggcgucgaaugacgccaacccaucugauggguccacagccaaccucgucccagaggucaacaaugaggucauggcuuuggagcccguuguuggugccgcuauugcggcaccuguagcgggccaacaaaauguaauugaccccuggauuagaaguaauuuuguacaagccccugguggagaguuuacaguauccccuagaaacgcuccgggugagauacuauggagcgcgcccuugggcccugaucuaaaccccuaccuuucccauuuggccagaauguacaaugguuaugcaggugguuuugaagugcagguaauccucgcggggaacgcguucaccgccgggaaaaucauauuugcagcagucccaccaaauuuuccaacugaaggcuugagccccagccaggucacuauguucccccauauaauaguagauguuaggcaauuggaaccugugcugauccccuuaccugauguuaggaauaauuucuaucauuauaaucaaucaaaugauucuacuauuaaauugauagcaaugcuguauacaccacuuagggccaauaaugcuggggaugaugucuucacagucucuugucgaguccucacgaggccaucccccgacuuugacuucauauucuuggugccacccacaguugaaucaagaacuaaaccauucaccgucccaaucuuaacuguugaggaaauguccaauucaagauuccccguuccuuuggaaaaguuguacacgggucccagcagugcuuuuguuguccaaccacaaaauggcaggugcacgacugauggcgugcucuuaggcaccacccagcugucugcugucaacaucugcaccuucagaggggaugucacccacauugcaggcagucaugauuacacaaugaauuuggcuucucaaaauuggaacaauuaugacccaacagaggaaaucccagccccucugggaaccccagauuucgugggaaagauccaaggcgugcucacccaaaccacaagagaggauggcucgacccgcgcccacaaagcuacagugagcacugggaguguccacuuuacuccaaagcugggcaguguucaauacaccacugacacaaacaaugacuuucaaacuggccaaaacacgaaauucaccccagucggcgucauccaggacgguaguaaccaucaaaaugaaccccaacaaugggugcucccaaacuacucagguagaacuggucauaaugugcacuuagccccugccguugcccccacuuuuccgggugagcaacuucuuuucuuuagguccacuaugcccggauguagcggguaucccaauaugaaucuggauugccuacucccccaggaaugggugcagcacuucuaccaagaagcagcuccagcacaaucugauguggcucugcugagauuugugaauccagacacagguaggguucuguuugagugcaaacuccauaaaucaggcuaugucacaguggcucacacuggcccgcaugauuugguuaucccccccaaugguuauuuuagauuugauuccugggucaaucaguuuuacacacuugccccuaugggaaauggagcggggcguagacgugcauuauaa

SEQ ID NO: 6243 - RNA, 1623 nt, Artificial Sequence
  capsid_protein__Norovirus__BAF74514
augaagauggcguccaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguauacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggagaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcacccucagaggggaugucacccacauugcagguacucauaauuacacaaugaauuuggcuucucaaaauuggaacaauuaugacccaacagaagaaaucccagccccucuggggaccccagauuucgugggaaggauccaaggcgugcucacccaaacuacaaggggggauggcucuacccgcggccacaaagcuacagugagcacuggggauguccacuucacuccaaagcugggcaguguucaguucaacacugacacaaacaaugauuuugaaauuggccaaaacacgagauucaccccagucgguguuguccaggaugguaauggcacccaccaaaaugaaccccaacaaugggugcuuccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcauuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuauuuuagauuugauuccugggucaaccaauucuacacacuugcccccaugggaaaugggacggggcguagacgugcauuauaa

SEQ ID NO: 6244 - RNA, 1620 nt, Artificial Sequence
  capsid_protein__Norovirus__BAF74515
augaagauggcgucgaaugacgccaacccaucugauggguccgcagccaaccucgucccagaggucaacaaugagguuauggcucuggagcccguuguuggugccgccauugcggcaccuguagcgggccaacaaaacauaauugaccccuggauuagaaauaauuuuguacaagccccugguggagaauucacaguguccccuagaaaugcuccaggugaaauacuauggagcgcaccuuugggcccugauuugaaccccuaccuuucucauuugucuagaauguauaaugguuaugcaggugguuuugaagugcaagugauccucgcggggaacgcguucaccgccgggaaggucauauuugcagcagucccuccaaacuucccaacugaaggucugagcccuagccaaguuacuauguucccccacauaauuguagauguuagacaauuggaaccuguguugaucccccuacccgauguuaggaauaauuuuuaccauuacaaucaggcacaugauucuacccucaaguugauagcaaugcuguauacaccacuuagagcuaauaaugccggggaugauguguucacagucucuugucgaguucucacgaggccaucccccgauuuugauuuuauauuucuggugccacccacaguugaaucaagaacuaaaccauuuacugucccagucuugaccgucgaggaaaugacuaauucaagauuccccauuccuuuggaaaagcuuuacacgggcccuagcagugcuauuguuguucaaccacaaaauggcagaugcacgacugacggugugcuacugggcaccacccagcugucagcugucaauaucugcaccuucaggggggaugucacccauauugcgggcagccgcaacuacacaaugaauuuggcaucccaaaacuggaacaauuaugacccaacagaagaaaucccagccccccugggaacaccagacuuugugggaaagauucaaggccugcucacccagaccacaagagcggacgguucgacccgugcccacaaggccacagugagcacugggaguguccacuucaccccaaagcuggguaguguucaauucuccacugacacagauaaugacuuccagccuggccaaaauacaaaguucaccccaguuggcgucauccaagacggcgaccgccaccaaaacgaaccccagcaaugggugcucccugauuucucagguagaaccggucauaaugugcaccuggccccugcuguugcccccacuuucccgggugagcagcuucuuuucuuuagguccaccaugccaggacguaguggguaccccaacaugaaucuggauugccuacucccucaggaauggguguugcacuuuuaccaggaaucagccccagcacaauccgauguggcucuauuaagauuugugaacccggauacaaacaggguucuguuugagugcaagcuucauaaaucaggcuauaucacaguggcccacaccggccaucaugauuugauucucccccccaaugguuauuuuagauuugauucuugggucaaucaauucuauacacucgcccccaugggaaauggagcggggcgcaggcgugcaccauaa

SEQ ID NO: 6245 - RNA, 1623 nt, Artificial Sequence
  capsid_protein__Norovirus__BAF74516
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaguccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccagauguuaggaacaaucuuuaucauuauaaucaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaaccaaaccauucaccgucccaauuuuaacuggugaggaaaugaccaauucaagauuccccauuccuuuggaaaaguuguucacggguccuagcggugccuuuguuguucaaccacaaaauggcaggugcacgacugauggcgugcucuuaggcaccacucagcuguugccugucaacaucugcaccuucagaggggaugucacccacauugcagguacucauaauuacacaaugaauuuggcuucucagaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuagucacaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 6246 - RNA, 1623 nt, Artificial Sequence
  capsid_protein__Norovirus__BAF74517
augaagauggcgucgaaugacgccaacccaucugauggguccgcagccaaccucgucccagaggucaacaaugagguuauggcuuuggagcccguuguuggugccgcuauugcggcaccuguagcgggccaacaaaacguaauugaccccuggauuagaaauaauuuuguacaagccccugguggagaguuuacaguauccccuagaaacgcuccaggugaaauacuauggagcgcgccuuugggcccugaucugaaucccuaccuuucucacuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuauaaccaaucaaaugacuccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauucccuuggaaaaguuguuuacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggauggcaauggugcccaccaaaaugaaccccagcaaugggugcucccaagcuacucagguagaacuggucacaaugugcaccuagcccccgccguagcccccacuuuuccaggugagcaacuucuuuucuucagguccacuaugcccggaugcagcggguaccccaacaugaauuuggauugucuacucccccaggaaugggugcagcacuucuaccaagaggcagcaccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugacuccugggucaaccaauucuacacacuugcccccaugggaaaugggacggggcguagacgugcauuauaa

SEQ ID NO: 6247 - RNA, 1623 nt, Artificial Sequence
  capsid_protein__Norovirus__BAF74518
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaauuauauuugcagcagucccaccaaauuucccaacugaaggcuugagccccagccaggucacuauguuuccccauauaauaguagauguuaggcaacuggaaccuguguugauccccuuaccugauguuaggaacaauuucuaucacuacaaucaaucaaaugaccccaccauuaaauugauagcaaugcuguauacaccacucagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggagaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucaccccaaagcugggcaguguccaauucaacacugauacaaacaaugauuuugaaacuggccaaaacacgagauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaauaugaauuuggauugucuacucccccaggaaugggugcagcacuucuaccaagaggcagcuccagcacaaucugauguggcucugcuaagauuugugaauccagacacagguaggguucuauuugagugcaaacuucauaaaucaggcuaugucacaguggcucacacuggccagcaugauuugguuaucccccccaauggcuacuuuagauuugauucuugggucaaccaauucuacacacuugcccccaugggaaaugggacggggcguagacgugcauuauaa

SEQ ID NO: 6248 - RNA, 1623 nt, Artificial Sequence
  capsid_protein__Norovirus__BAF74519
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguguccccuagaaacgcuccaggugaaauauuauggagcgcgcccuugggcccugauuugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguucucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggagaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaagucaggcuaucucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 6249 - RNA, 1623 nt, Artificial Sequence
  capsid_protein__Norovirus__BAF74520
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccacuauuaaauuaauagcaaugcuguacacaccacuuagggcuaauaaugcuggggaagaugucuucacagucucuugucgaguccucacgaggccaucccccgauuuugauuucauauucuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacagauggcgugcucuuaggcacuacccaacuaucuccugucaacaucugcaccuucagaggggaugucacccacauugcaggcacucauaauuacacaaugaauuuggcuucucaaaauuggaacaauuaugacccaacagaagaaaucccagccccucuggggaccccagauuucgugggaaggauccaaggcaugcucacucaaaccacaaggggggauggcucuacccgcggccacaaagccacagugagcacuggggauguccacuucacuccaaagcugggcaguauucaguucaacacugauacaaacaaugauuuugaaacuggccaaaacacgaaauucaccccagucggugucauccaggaugguaauggugcccaccaaaaugaaccucaacaaugggugcucccaagcuacucagguagaacuggucauaauguacaccuagcccccgccguggccccuacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuuguaaauccagacaccgguaggguccuauuugagugcaagcuucauaaaucaggcuauaucacaguggcccacacuggucagcaugauuugguuaucccccccaauggcuacuuuagauuugauuccugggucaaccaauucuacacacuugcccccaugggaaaugggacggggcguagacgugcauuauaa

SEQ ID NO: 6250 - RNA, 1623 nt, Artificial Sequence
  capsid_protein__Norovirus__BAF74521
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucacuuggccagaauguacaauggcuaugcagguggcuuugaagugcagguaauccuugcggggaaugcguucaccgccgggaaaaucauauuugcagcagucccaccaaguuucccaacugaaggcuugagccccagccaaguuacuauguucccccauauaauaguagauguuaggcaacuggaaccuguguugauccccuuaccugauguuaggaacaauuucuaucacuauaaucaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuagguacuacccaacugucuccugucaacaucugcaccuucagaggggaugucacccacauugcaggcacucauaauuacacaaugaauuuggcuucucaaaauuggaacaacuaugacccaacagaagaaaucccagccccucuggggaccccagauuucgugggaaggauccaaggcaugcucacccaaacuacaaggggggauggcucuacccgcggccacaaagccacagugagcacuggggauguccauuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcaacacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 6251 - RNA, 1623 nt, Artificial Sequence
  capsid_protein__Norovirus__BAF74522
augaagauggcgucgaaugacgccaccccaucugauggguccacagccaaccucgucccagaggucaacaaugagguuauggcucuggagcccguuguuggugccgcuauugcggcaccuguagcgggccaacagaauguaauugaccccuggauuagaaauaauuuuguacaagccccugguggagaguuuacaguauccccuagaaacgcuccaggugaaauacuauggagcgcgcccuugggcccugaucugaauccuuaccuuucucauuuggccagaauguacaauggcuaugcagguggcuuugaagugcagguaauccuugcggggaaugcguucaccgccgggaaaaucauauuugcagcagucccaccaaguuucccaacugaaggcuugagccccagccagguuacuauguucccccauauaauaguagauguuaggcaacuggaaccuguguugauccccuuaccugauguuaggaacaauuucuaucacuacaaccaaucaaaugaccccacuauuaaauugauagcaaugcuguacacaccacuuagggcuaauaaugcuggggaagaugucuucacagucucuugucgaguccucacgaggccaucccccgauuuugauuucauauuccuggugccacccacaguugagucaaggacuaaaccauucaccgucccaaucuuaacuguugaagaaaugaccaauucaagauuccccauuccuuuggaaaagcuguucacggguccuagcggcgccuuuguuguucaaccacaaaauggcaggugcacgacagauggcgugcucuuaggcacuacccaacuaucuccugucaauaucugcaccuucagaggggaugucacccacauugcagguacucauaauuacacaaugaauuuggcuucucaaaauuggaacaauuaugacccaacagaagaaaucccagccccuuuggggaccccagauuucgugggaaggauccaaggcaugcucacccaaaccacaaggggggauggcucuacccgcggccacaaagcuacagugagcacuggggauguccacuucacuccaaagcugggcaguguucaauucgacacugauacaaacagugauuuugaaacuggccaaaacacgaaauucaccccagucgguguuguccaggaugguaauggugcccaccaaaaugaaccucaacaaugggugcucccaagcuacucagguagaacuggccacaaugcacaccuagcccccgccguggccccuacuuuuccaggugagcagcuucuuuucuucagguccacuaugcccggaugcagcggguaccccaacaugaauuuggauugucuacucccccaggaaugggugcagcacuucuaccaagaggcagcuccagcacaaucugauguggcccugcuaagauuugugaauccagacaccgguaggguucuauuugagugcaagcuucauaaaucaggcuaugucacaguggcccacacuggucagcaugauuugguuaucccccccaauggcuacuuuagauuugauuccugggucaaccaguucuacacacuugcccccaugggaaaugggacggggcguagacgugcauuauaa

SEQ ID NO: 6252 - RNA, 1623 nt, Artificial Sequence
  capsid_protein__Norovirus__BAF74523
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaacuuuguacaagccccugguggagaguuuacaguauccccuagaaacgcuccaggugaaauauuauggagcgcgcccuugggcccugauuugaaucccuaccuuucccauuuggccagaauguauaaugguuaugcaggugguuuugaagugcagguaauccuagcggggaacgcguucaccgccgggaaaaucauauuugcagcagucccaccaaauuucccaacugaaggcuugagccccagccaggucacuauguucccccauauaauaguagauguuaggcagcuggaaccuguguugauccccuugccugauguuaggaacaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuucuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccguggucacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccagauuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6253 - RNA, 1623 nt, Artificial Sequence
  capsid_protein__Norovirus__BAF74524
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguguccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucauuacaaucaaucaaaugaccccaccaucaaauugauagcaaugcuguauacaccacucagggcuaacaaugcuggggacgaugucuucacagucucuugucgaguucucacgagaccauccccugauuuugauuucauauuuuuggugccacccacaguugagucaagaacuaaaccauucucugucccaaucuuaacuguugaggagaugaccaauucaagauucccuauuccuuuggaaaagcuguucacgggucccagcagugccuuuguuguacaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccagauuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugacuugguuaucccccccaauggcuauuuuagauuugauuccugggucaaccaauucuacacacuugcccccaugggaaauggagcggggcguagacgugcauuauaa

SEQ ID NO: 6254 - RNA, 1623 nt, Artificial Sequence
  capsid_protein__Norovirus__BAF74525
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauauuauggagugcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuucuggugccacccacaguugagucaagaacuaaaccauucucugucccaaucuuaacugucgaggagaugaccaauucaagauucccuauuccuuuggaaaaguuguucacgggucccagcagugccuuuguuguucaaccacaaaauggcagaugcacgacugauggcgugcucuuagguaccacccaacugucuccugucaacaucugcaccuucagaggggaugucacccacauugcagguacucaaaauuacacaaugaaucuggccucccaaaauuggaacaauuacgauccaacagaagaaaucccagccccucugggaaccccagauuuuguaggaaagauccaaggcgugcucacccaaaccacaaggagggauggcucgacccguggucacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccagauuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6255 - RNA, 1623 nt, Artificial Sequence
  capsid_protein__Norovirus__BAF74526
augaagauggcgucgaaugacgccaccccaucugauggguccacagccaaccucgucccagaggucaacacugagguuauggcuuuggagcccguuguuggcgccgcgauugcggcaccuguagcgggccaacaaaauguaauugaccccuggauuagaaauaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucacuacaaucaaucaaaugaccccaccaucaaauugauagcaaugcuguauacaccacuuaggacuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguauccacuuuaccccaaagcugggcaguguucaauucuccacugauacaagcaaugacuuugaaacuggccaaaacacgagauucaccccagucggugucguccaggauggcaguaccacccaccaaaaugaaccccaacaaugggugcucccagacuauucagguagagauagucacaauguacaccuagccccugccguggcccccacuuuuccgggugagcaacuucuuuucuuuagguccaccaugcccggaugcagcggguaucccaacaugaauuuggauugccuacucccccaggagugggugcaacacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6256 - RNA, 1623 nt, Artificial Sequence
  capsid_protein__Norovirus__BAF74527
augaagauggcgucgaaugacgccaccccaucugauggguccacagccaaccucgucccagaggucaacaaugagguuauggcuuuggagcccguuguuggcgccgcgauugcggcaccuguagcgggccaacaaaauguaauugaccccuggauuagaaauaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucacuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguauccacuuuaccccaaagcugggcaguguucaauucuccacugauacaagcaaugacuuugaaacuggccaaaacacgagauucaccccagucggugucguccaggauggcaguaccacccaccaaaaugaaccccaacaaugggugcucccagacuauucagguagagauagucacaauguacaccuagccccugccguggcccccacuuuuccgggugagcaacuucuuuucuuuagguccaccaugcccggaugcagcggguaucccaacaugaauuuggauugccuacucccccaggagugggugcaacacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6257 - RNA, 1620 nt, Artificial Sequence
  capsid_protein__Norovirus__BAF95499
augaagauggcgucgaaugacgccaacccaucugauggguccacagccaaccucgucccagaggucaacaaugaggucauggcuuuggagcccguuguuggugccgcuauugcggcaccuguagcgggccaacaaaauguaauugaccccuggauuagaaauaauuuuguacaagccccugguggagaguuuacaguguccccuagaaacgcuccgggugagauacuauggagcgcgcccuugggcccugaucugaaccccuaccuuucccauuuggccagaauguacaaugguuaugcaggugguuuugaagugcagguaauccuugcggggaacgcguucaccgccgggaaaaucauauuugcagcagucccaccaaauuuuccaacugaaggcuugagcccuagucaggucacuauguucccccauauaauaguagauguuaggcaauuggaaccugugcugauccccuuaccugaugucaggaauaauuucuaccacuacaaucaaucaaaugauucuaccauuaaauugauagcaaugcuguauacaccacuuagggccaauaaugcuggggaugaugucuucacagucucuugucgaguccucacgaggccaucccccgacuucgauuucauauucuuggugccacccacaguugaaucaagaacuaaaccauucaccgucccaaucuuaacuguugaggaaauguccaauucaagauuccccguuccuuuggaaaaguuguacacgggucccagcagugcuuuuguuguccaaccacaaaauggcaggugcacgacugacggcgugcucuuaggcaccacccagcugucugcugucaacaucugcaccuucagaggggaugucacccacauugcaggcagucaugauuacacaaugaauuuggcuucucaaaauuggaacaauuaugacccaacagaagaaaucccagcuccucugggaaccccagauuucgugggaaagauccaaggcgugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacgguaguaaccaucaaaaugaaccccaacaaugggugcucccaaacuauucagguagaacuggucauaaugugcacuuagccccugccguugcccccacuuuuccgggugagcaacuucuuuucuuuagguccacuaugcccggauguagcggguaucccaauaugaaucuggauugccuacucccccaggaaugggugcagcacuucuaccaagaagcagcuccagcacaauccgauguggcucuguugagauuugugaauccagacacagguaggguucuguuugagugcaaacuccauaaaucaggcuaugucacaguggcucacacuggcccgcaugauuugguuaucccccccaaugguuauuuuagauuugauucuuggguuaaucaguuuuacacacuugccccuaugggaaauggagcggggcguagacgugcauuauaa

SEQ ID NO: 6258 - RNA, 1620 nt, Artificial Sequence
  capsid_protein__Norovirus__BAF95501
augaagauggcgucgaaugacgucaacccaucugauggguccgcagccaaccucgucccagaggucaacaaugagguuauggcucuggagcccguuguuggugccgccauugcggcaccuguagcgggccaacaaaacauaauugaccccuggauuagaaauaauuuuguacaagcuccugguggagaauucacaguguccccuaggaaugcuccaggugaaauacuauggagcgcacccuugggcccugauuugaaccccuaccuuucucauuugucuagaauguauaaugguuaugcaggugguuuugaagugcaagugauccucgcggggaacgcguucaccgcugggaaggucauauuugcggcagucccuccaaacuucccaacugaaggucugagcccuagucaaguuacuauguucccccauauaauuguagauguuagacaauuagaaccuguguugaucccccuacccgauguuaggaauaacuuuuaccauuacaaucaggcacaugauucuacccucaaguugauagcaaugcuguacacaccacuuagagcuaauaaugccggggaugauguguucacagucucuugccgaguucucacgaggccaucccccgauuuugauuuuauauuucuggugccacccacaguugaaucaagaacuaaaccauuuacugucccagucuugaccgucgaggaaaugacuaauucaagauuccccauuccuuuggaaaagcuuuacacgggcccuaguagugccuuuguuguccaaccacaaaauggcagaugcacgacugacgguguguuacugggcacuacccagcugucagcugucaauaucugcaccuucaggggggacgucacccauauugcgggcagccgcaacuacacaaugaauuuggcaucccaaaacuggaacaauuaugacccaacagaagagaucccagccccccugggaacgccagacuuugugggaaagauccaaggcuugcucacccagaccacaagagcggacgguucgacccgugcccacaaggccacagugagcacugggaguguccacuucaccccaaagcuggguaguguucaauucuccacugacacagauaaugacuuccagccuggccaaaauacaaaguucaccccaguuggcgucauccaagacggcgaccgccaccaaaacgaaccccagcaaugggugcucccagauuacucagguagaacuggccacaaugugcaccuggccccugcuguugcccccacuuuccccggugagcagcuucuuuucuuuagguccaccaugccaggauguaguggguaccccaacaugaaucuggauugccuacucccucaggaauggguguugcacuuuuaucaggaaucagccccagcacaauccgauguggccuugcuaagauuugugaacccggacacaaacagggucuuguuugagugcaagcuucauaagucaggcuauauuacaguggcccacaccggccagcaugauuugauucucccccccaaugguuauuuuagauuugauucuugggucaaucaauucuacacacucgcccccaugggaaauggagcggggcgcaggcgugcaccauaa

SEQ ID NO: 6259 - RNA, 1623 nt, Artificial Sequence
  capsid_protein__Norovirus__BAF95503
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgccauugggcccugaucugaaucccuaccuuucucauuuggccagaauguacaauggcuaugcagguggcuuugaagugcaggugauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccguuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucguggguaggauccaaggcaugcucacccaaacuacaaagggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccaccaugcccggaugcagcggguaccccaacaugaauuuggauugucuacucccccaggaaugggugcagcauuucuaccaagaggcagcuccagcacaaucugauguggcucugcuaagauuugugaauccagacacagguaggguucuauuugagugcaagcuucauaagucaggcuaugucacaguggcucacacuggccagcaugauuugguuaucccccccaauggcuacuuuagauuugauuccugggucaaccaguucuacacacuugcccccaugggaaaugggacggggcguagacgugcauuauaa

SEQ ID NO: 6260 - RNA, 1623 nt, Artificial Sequence
  capsid_protein__Norovirus__BAF95505
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgccauugggcccugaucugaaucccuaccuuucccauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugacccuaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaguuuuaacuguugaggaaaugaccaauucaagauuccccauuccguuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaagggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccaccaugcccggaugcagcggguaccccaacaugaauuuggauugucuacucccccaggaaugggugcagcauuucuaccaagaggcagcuccagcacaaucugauguggcucugcuaagauuugugaauccagacacagguaggguucuauuugagugcaagcuucauaagucaggcuaugucacaguggcccacacuggccagcaugauuugguuaucccccccaauggcuacuuuagauuugauuccugggucaaccaguucuacacacuugcccccaugggaaaugggacggggcguagacgugcauuauaa

SEQ ID NO: 6261 - RNA, 1623 nt, Artificial Sequence
  capsid_protein__Norovirus__BAF95507
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccgaccgaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuuuuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcaccacccaacugucccccgucaacaucugcaccuucagaggcgaugucacccacauuccagguacucguacuuacagaaugaauuuggcuucucaaaauuggaacaauuaugauccaacagaagaaaucccagccccucugggaacuccagauuucgugggaaagauccaaggcaugcucacccaaaccacaaagggagacggcucgacccguggucacaaagcuacagugagcacugggaguguugacuuuacuccaaagcugggcagcguucaguucgccacugacacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuuuagaucuacuaugcccggaugcaguggguaucccaauauggauuuggauugucuacucccucaggaaugggugcagcacuucuaccaagaggcagccccaucacaaucugauguggcuuugcugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 6262 - RNA, 1623 nt, Artificial Sequence
  capsid_protein__Norovirus__BAF95509
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccauauaauaguagauguuaggcaacuggaaccuguguugaucccccugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaacucaagauucccuauuccuuuggaaaaguuguucacgggucccagcagugccuuuguuguucaaccacaaaauggcagaugcacgacugauggcgugcuuuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggggggauggcucgacccgcggucacaaagcuacaguaagcacuggaaguguccacuuuaccccaaagcugggcaguguucaauucucuacugauacaagcaaugacuuugaaacuggccaaaacacgagauucaccccagucggugucguccaggaugguaguaccacccaccaaaaugaaccccaacaaugggugcucccaaacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugaguguaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6263 - RNA, 1623 nt, Artificial Sequence
  capsid_protein__Norovirus__BAF95511
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaacuggaaccuguguugaucccccugccugauguuaggaauaauuuuuaucauuacaaucaaucaaaugaccccaccaucaaauugauagcaaugcuguauacaccacucagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagcgccuuuguuguucagccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagguuuaccccagucgguguuguccaggaugguagcaccacccaccaaaaugaaccccaacaaugggugcucccaaacuauucagguagagauagucacaauguacaccuagccccugccguggcccccacuuucccgggugagcaacuucuuuucuuuagguccacuaugcccggaugcagcggguaucccaacaugaauuuggauugccuacucccccaggagugggugcaacacuucuaccaagagucagccccagcacaaucugauguggcacugcugagauuugugaauccagacacagguagggucuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuguaa

SEQ ID NO: 6264 - RNA, 1623 nt, Artificial Sequence
  capsid_protein__Norovirus__BAF95513
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguguccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuagacaacuggaaccuguguugauccccuugccugauguuagaaauaacuucuaucauuauaaccaaucaaaugacuccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcuccuagguacuacccaacugucuccugucaacaucugcaccuucagaggggaugucacccacauugcaggcacucaaaauuacacaaugaaucuggccucccaaaauuggaacaauuaugacccaacagaagaaaucccagccccucugggaaccccagauuuuguaggaaagauccaaggcgugcucacucaaaccacaaggagggauggcucgacccgcggucacaaagccacagugagcacuggaaguguccacuucaccccaaagcugggcaguguucaauucuccacugacacaagcaaugacuuugaaacuggccaaaacacgagauucaccccagucggugucguccaggaugguaguaccacccaucaaaaugaaccccaacaaugggugcucccaaacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6265 - RNA, 1623 nt, Artificial Sequence
  capsid_protein__Norovirus__BAF95515
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgccccuaggcccugaucugaauccauaccuuucucaccuggcuagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccagguacucgcacuuacagaaugaauuuggcuucucaaaauuggaacaauuaugacccaacagaagagaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacgugcauuauaa

SEQ ID NO: 6266 - RNA, 1623 nt, Artificial Sequence
  capsid_protein__Norovirus__BAF95517
augaagauggcgucgaaugacgccagcccaucugauggguccgcagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacgguauccccuagaaacgcuccaggugaaauacuauggagcgcgcccuuaggcccugaucugaauccauaccuuucucaccuggccagaauguauaaugguuaugcaggugguuuugaagugcagguaauccucgcggggaacgcguucaccgccgggaaaaucauauuugcagcagucccaccaaauuucccaacugaaggcuugagucccagccaggucacuauguucccccauauaauaguagauguuaggcaauuggaaccuguguugauccccuuaccugauguuaggaauaauuucuaccauuauaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuucagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagauucaccccagucggugucauccaggaugguaguagugcccacagaaaugaaccccaacaauggguacucccagauuacucagguagaacuguucauaauguacaccuagccccugccguagcccccacuuuuccaggugagcaacuucuuuucuucagaucuacuaugcccggaugcaguggguaucccaauauggauuuggauugucugcucccccaggaaugggugcagcacuucuaccaagaggcagccccaucacaaucugauguggcuuugcugagauuugugaauccagacacagguaggguucuguuugagugcaagcuucauaaagcaggcuaugucacaguggcucacacuggccagcaugauuugguuaucccccccaauggcuacuuuagauuugacuccugggucaaccaguucuacacacuugcccccaugggaaauggagcggggcguagacgugcauuauaa

SEQ ID NO: 6267 - RNA, 1623 nt, Artificial Sequence
  capsid_protein__Norovirus__BAF95519
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagaugucaggcaacuggaaccuguguugauccccuugccugauguuaggaacaauuucuaucauuacaaucaaucaaaugacuccaccaucaaauugauagcaaugcuguacacaccacuuagggcuaacaaugcuggggacgaugucuucacagucucuugucgaguucucacgagaccaucccccgacuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggugugcucuuagguacuacccaacugucuccugucaacaucugcaccuucagaggggaugucacccacauugcaggcacucaaaauuacacaaugaaucuggccucccaaaauuggaacaauuaugacccaacagaagaaaucccagccccucugggaaccccagauuuuguaggaaagauccaaggcgugcucacccaaaccacaacgagggauggcucgacccgcggccacaaagccacagugagcacuggaaguguccacuuuaccccaaagcugggcaguguucaauucuccacugauacaagcaaugacuuugaaaccggccaaaacacgagauucaccccagucggugucguccaggaugguagcaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugaguguaagcuucauaaaucaggcuauguaacaguggcucacacuggccaacaugauuugguuaucccccccaaugguuauuuuagauuugauuccugggucaaccaauuuuacacacuugcccccaugggaaauggagcggggcguagacgugcauuauaa

SEQ ID NO: 6268 - RNA, 1623 nt, Artificial Sequence
  capsid_protein__Norovirus__BAF95521
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaauuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaacgaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggauggugguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguuuuguuugaguguaagcuucauaaaucaggcuaugucacaguggcucacacuggccaacaugauuuaguuaucccccccaauggcuauuuuagauuugauuccugggucaaccaguucuacacacuugcccccaugggaaaugggacggggcguagacgugcauuauaa

SEQ ID NO: 6269 - RNA, 1623 nt, Artificial Sequence
  capsid_protein__Norovirus__BAF95523
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcugguacucaagaauacacaaugaaucuggccucccaaaacuggaacaauuaugacccgacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagccacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuacacacuugcccccaugggaaauggaacggggcguagacgugcauuauaa

SEQ ID NO: 6270 - RNA, 1623 nt, Artificial Sequence
  capsid_protein__Norovirus__BAF95525
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaacuuuguacaagccccugguggagaguucacaguauccccuagaaacgcuccaggugaaauacuauggagcgcgcccuuaggcccugauuugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggacgaugucuucacagucucuugucgaguccucacgaggccaucccccgauuuugauuucauauuccuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaacggcaggugcacgacugauggcgugcucuuaggcacuacccaacugucccccgucaacaucugcaccuucagaggcgaugucacccacauuccagguacucguacuuacagaaugaauuuggcuucucaaaauuggaacaauuaugacccaacagaagagaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguaguacccacagaaaugaaccccaacaauggguacucccagacuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagauacagguaggguucuauuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguaggcgugcauuauaa

SEQ ID NO: 6271 - RNA, 1623 nt, Artificial Sequence
  capsid_protein__Norovirus__BAF95527
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuugugcaagccccugguggagaguucacaguauccccuagaaacgcuccaggugaaauacuauggagcgcgcccuuaggcccugaucugaauccauaccuuucucaccuggccagaauguacaaugguuaugcaggugguuuugacgugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuucccauuccuuuggaaaaauuguucacgggucccagcagugccuuugucguccaaccacaaaauggcaggugcacgacugauggcgugcucuuaggcacuacccaacugucccccgucaacaucugcaccuucagaggagaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuucacuccaaagcugggcagcguucaguucgccacugacacagacaaugauuuugaaacuggccaaaacacaagguucaccccagucggugucauccaggaugguaguaguacccacagaaaugaaccccaacaauggguacucccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucacaaagcaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6272 - RNA, 1623 nt, Artificial Sequence
  capsid_protein__Norovirus__BAF95529
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucaucuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcguacucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguaugcuuacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugagccccaacaaugggugcucccaaguuauucagguagaaauguccauaauguacaccuagcccccgcuguagcccccacuuuuccgggugagcaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6273 - RNA, 1623 nt, Artificial Sequence
  capsid_protein__Norovirus__BAF95531
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuacuauuaaauugauagcaaugcuguauacaccacuuagggccaauaaugcuggggaagaugucuucacagucucuugucgaguccucacgaggccguccccugauuuugacuucauauuuuugguaccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaggcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaaugugcaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagccccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6274 - RNA, 1623 nt, Artificial Sequence
  capsid_protein__Norovirus__BAG30923
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguuuacaguguccccuagaaaugcuccaggugagauacuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcaguuccaccuaacuuuccaacugaaggcuugagccccagccagguuacuauguucccccauauaauaguagauguuaggcaauuggaaccuguguugauccccuuaccugauguuaggaauaacuucuaucacuacaaucaaucaaaugacccuaccauuaaauugauagcaaugcuguauacaccacuuagggcuaauaaugcuggggaugaugucuucacagucucuugucgaguccucacgagaccguccccugacuuugauuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuaggcaccacccagcugucugcugucaacaucugcaccuuuagaggggaugucacucacauugcaggcucucgcaauuauacaaugaauuuggccucucaaaauuggaacaacuaugauccaacagaagaaaucccagccccccugggcaccccagauuucgugggaaagauccaaggcaugcucacccaaaccacaagaagugauggcucgacccgcggccacaaggccacagugcucacugggagugccgacuucgccccaaaauugggcagaguccaauucgccacugacacagacaacgauuucgaaucuggccaaaacacgaaauucaccccaguuggcgucauccaggaugguuccacuacccaccgaaaugaaccucaacaauggguacucccaaauuacucagguagaacuggucauaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagccccagcacaaucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacuugcccccaugggaaauggaacggggcguagacgugcuguauaa

SEQ ID NO: 6275 - RNA, 1629 nt, Artificial Sequence
  capsid_protein__Norovirus__BAG34630
augaagauggcgucgaaugacgccgcuccaucuacugauggugcagccggccucgugccagaaaguaauaaugaggucauggcucuugaacccguggcuggugccgcuuuggcagccccggucaccggucaaacaaauauuauagacccuuggauuagagcaaauuuuguccaggccccuaauggugaguuuacaguuucuccccguaaugccccuggugaagugcuauugaaucuagaguuggguccagaauuaaauccuuaucuggcacauuuagcaagaauguacaacggguacgccggugggauggaggugcaggucauguuggcugggaacgcguucacagccggcaaguuggucuucgccgcugugccaccucauuucccgguugaaaaccuuaguccacagcaaauuaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguguugacuagacccuccccugauuuugauuuuacauaucuggugccaccaacaguggaauccaaaacaaaaccauuuacccuuccaauccucacacuuggggagcuuuccaauucuagauucccagugucuauagaucagauguacacuagccccaaugaaguuauaucugugcagugucaaaaugguaggugcacacuggauggggagcuccaaggaacaacacaacuccaggucaguggcauuugugcuuucaagggagaagugaccgcccacuugcaugacaaugaccaccuauauaaugucaccauuacaaacuugaauggguccccuuuugaccccuccgaggacauccccgccccucugggcgugccugacuuccagggaagggucuuuggugucaucucccaaagagacaaacagaaugccgcuggacauaaugaaccagcaaacaggggacacgacgcugugguuccuacuuauacagcacaguacacuccaaaauugggucagauucaaauuggcacauggcagaccgacgaucucacagucaaucaaccaguuaaauuuaccccaguuggccucaaugauacugaacauuuuaaccaauggguggucccuagauaugcuggugcucuaaaucuuaacacaaaucuugcccccucuguugcuccaguauuuccaggggagcgccugcucuuuuucagaucauacaucccccucaagggugguuauggaaauccagccauugauugucuacuaccacaagagugggugcaacauuucuaucaggaagcagccccuucaaugagugagguggcucuugucagauacaucaacccagacacuggucgggcacuguuugaggccaagcuccacagagcugguuucaugacggucucaagcaacaccagugcuccggugguugugccugccaacggauacuucagauuugacucuugggugaaccaauucuauucucucgcccccaugggaacuggaaaugggcguagaaggguucaauaa

SEQ ID NO: 6276 - RNA, 1629 nt, Artificial Sequence
  capsid_protein__Norovirus__BAG34632
augaagauggcgucgaaugacgccgcuccaucuacugauggugcagccggccucgugccagaaaguaacaaugagguuauggcucuugagcccguggcuggugcugcuuuagcagccccgguuacuggccaaacaaauauuauagacccuuggaucagagcaaauuuuguccaggcccccaauggugaauucaccguuuccccccggaaugccccuggugaaguuuuauugaaucuagaauuggguccagaauugaauccuuaucuggcacauuuggcgaggauguacaacgguuaugcuggugguauggaggugcaggucaugcuagcuggaaaugcguuuacagcuggaaaauuggucuuugccgccguaccaccccauuucccaguugaaaaucuuagcccccaacaaaucacuauguucccccaugugauuauagauguuagaaccuuagaaccuguuuuauuaccacucccugauguuaggaacaacuuuuuccauuauaaucagaaagaugacccuaaaaugaggauuguggccaugcucuacaccccccucagaucaaaugguucuggugaugauguguucacaguuucauguagggugcuaacuagacccuccccugauuuugacuucacauaucugguaccaccaacaguggaguccaaaacaaaaccauucacccuaccaauccucacacuuggugaauuguccaauuccagauuuccuguguccauagaccaaauguuuacuagccccaaugaggucauaucagugcagugucaaaacgggaggugcacguuggauggggagcuucaaggaacaacacagcuccagguuagugguaucuguguauucaagggagaggugacugcucacuugcacgauaaugaccaccuuuacaacaucacuauuacaaauuugaaugggucccccuuugacccuucugaggaugugccagccccauugggugugccagauuuucaaggaagaguuuuugguguuaucagccaaagagacaaccauaacgccagugggcacaaucaacccgcaaacagaggccacgaugccgugguucccaccuauacagcccaauauaccccaaaguuaggccagauccaaaucggcaccuggcagacugaugaccuaacagucaaucagccuguuaaauucaccccaguuggccuuaaugauguggaacauuucaaccaaugggugguucccagauaugcuggugcucuaaaccuaaauacaaaucuugcccccucuguugcaccgguguuuccgggggagcggcugcucuucuucagauccuaucucccccucaaaggugguuaugguaacccagucaucgacugccugcuaccacaggaaugggugcaacacuuuuaucaggaggccgccccuucaaugagugagguagcucuuguuagguacaucaauccagacacuggucgagcucuguuugaggccaagcuccacagagcugguuucaugacagucucaagcaacaccagcgccccagugguggugcccgccaacggguauuuuagauuugauucuuggguuaaucaguuuuacucucuugcccccaugggaacugggaaugggcgcagaagaauucaguaa

SEQ ID NO: 6277 - RNA, 1629 nt, Artificial Sequence
  capsid_protein__Norovirus__BAG34634
augaagauggcgucgaaugacgccgcuccaucuacugauggugcagccggccucgugccagaaaguaauaaugagguuauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugagucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucauuucccgguugaaaaccuuagcccacagcaaauuaccauguucccucaugugauuauagauguaaggacuuuggaaccuguuuuauuaccacucccugauguuagaaauaauuucuuccauuauaaucagaaagaugaucccaaaaugagaauuguggcuaugcuuuacaccccccuuaggucuaaugguucaggugaugauguguuuacagucuccugcaggguguugacuagacccuccccugauuuugauuuuacauaucuggugccaccaacaguggaaucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccacuuacaugacaaugaucaccuauauaaugucaccaucacaaacuugaauggguccccuuuugaucccuccgaggacaucccugccccucugggcguaccugacuuucagggaagggucuuuggugucaucucccaaagagacaaacacaaugccucuggacauaaugaaccagcaaacaggggacacgacgcuguggucccuacuuacacagcacaguacacuccaaaguugggucagauucaaauuggcacauggcagaccgacgaucuuacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcaacauuucuaucaggaagcagccccuucaaugagugagguggcccuugucagauacaucaacccggacacuggucgggcacuguuugaggccaagcuccacagagcugguuucaugacagucucaagcaacaccagugcuccggugguugugccugccaacggauacuucagguuugauucuugggugaaccaauucuauucucucgcccccaugggaacuggaaaugggcguagaaggguucaauaa

SEQ ID NO: 6278 - RNA, 1629 nt, Artificial Sequence
  capsid_protein__Norovirus__BAG34636
augaagauggcgucgaaugacgccgcuccaucuacugauggugcagccggccucgugccagaaaguaacaaugagguuauggcucuugagcccguggcuggugcugcuuuagcagccccgguuacuggccaaacaaauauuauagacccuuggaucagagcaaauuuuguccaggcccccaauggugaauucaccguuuccccccggaaugccccuggugaaguuuuauugaaucuagaauuggguccagaauugaauccuuaucuggcacauuuggcgaggauguacaacgguuaugcuggugguauggaggugcaggucaugcuagcuggaaaugcguuuacagcuggaaaauuggucuuugccgccguaccaccccauuucccaguugaaaaucuuagcccccaacaaaucacuauguucccccaugugauuauagauguuagaaccuuagaaccuguuuuauuaccacucccugauguuaggaacaacuuuuuccauuacaaucagaaagaugacccuaaaaugaggauuguggccaugcucuacaccccccucagaucaaaugguucuggugaugauguguucacaguuucauguagggugcuaacuagacccuccccugauuuugacuucacauaucugguaccaccaacaguggaguccaaaacaaaaccauucacccuaccaauccucacacuuggugaauuauccaauuccagauuuccuguguccauagaccaaauguuuacuagccccaaugaggucauaucagugcagugucaaaacgggaggugcacguuggauggggagcuucaaggaucaacgcagcuccagguuagugguaucugugcauucaagggagaggugacugcucacuugcacgacaaugaccaccuuuacaacaucacuauuacaaauuugaaugggucccccuuugacccuucugaggauguaccagccccauugggugugccagauuuucaaggaagaguuuuugguguuaucagccaaagagacaaccauaacgccagugggcacaaucaacccgcaaacagaggccacgaugccgugguucccaccuauacaucccaauauaccccaaaguuaggccagauccaaauuggcaccuggcagacugaugaccuaacagucaaucagccuguuaaauucaccccaguuggccucaaugauguggaacauuucaaccaaugggugguccccagauaugcuggugcucuaaaccuaaauacaaaucuugcccccucuguugcaccgguguuuccgggggagcggcugcucuucuucagauccuaucucccccucaaaggugguuaugguaacccagccaucgacugccugcuaccacaggaaugggugcaacacuuuuaucaggaggccgccccuucaaugagugagguagcucuuguuagguacauuaauccagacacuggucgagcucuguuugaggccaagcuccacagagcugguuucaugacagucucaagcaacaccagcgccccagugguggugcccgccaacggguauuuuagauuugauucuuggguuaaucaguuuuacucucuugcccccaugggaacugggaaugggcgcagaagaauucaguaa

SEQ ID NO: 6279 - RNA, 1629 nt, Artificial Sequence
  capsid_protein__Norovirus__BAG34638
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauucacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggagucuaaaacaaaaccauuuacccucccaauccucacacuuggggagcuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacauuccugccccucugggcguaccugacuuucagggaaggguuuuuggugucaucucccaaagagacaaacacaauuccccuggacauaaugaaccagcaaauagggggcacgacgcuguggucccuacuuacacgucacaguacacuccaaaauugggucagauucaaauuggcacauggcaaacugaugaucuuacagucaaccaaccagucaaauucaccccaguuggacucaaugacacugaacauuuuaaccaaugggugguccccagauaugcuggugcucuaaaccuuaauacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6280 - RNA, 1629 nt, Artificial Sequence
  capsid_protein__Norovirus__BAG34640
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguauacuccaaaauugggucagauucaaauuggcacauggcaaaccgaugaucuuacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6281 - RNA, 1629 nt, Artificial Sequence
  capsid_protein__Norovirus__BAG34642
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguguugacuagacccuccccugauuuugauuucacauaccuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggaacuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaaggguggcuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6282 - RNA, 1629 nt, Artificial Sequence
  capsid_protein__Norovirus__BAG34644
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacaguuucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaauaauuucuuucauuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguagaugcacacuggauggggagcuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6283 - RNA, 1629 nt, Artificial Sequence
  capsid_protein__Norovirus__BAG34646
augaagauggcgucgaaugacgccgcuccaucuacugauggugcagccggccucgugccagaaaguaauaaugaggucauggcucuugaacccguggcuggcgccgccuuggcagccccggucaccggucaaacaaauaucauagacccuuggauuagagcaaauuuuguccaggccccuaauggugaauuuacaguuucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaauaauuucuuucauuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguagaugcacacuggauggggagcuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6284 - RNA, 1629 nt, Artificial Sequence
  capsid_protein__Norovirus__BAG34648
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauucacagucucuccccguaaugccccuggugaagugcuauugagucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaacaauuucuuccauuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaucaacacaacuccaagucaguggcauuugugcuuucaagggagaagugaccgcccacuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagucaaauucaccccaguuggacucaaugacacugaacauuuuaaccaaugggugguccccagauaugcuggugcucuaaaucuuaacacaaaucuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6285 - RNA, 1629 nt, Artificial Sequence
  capsid_protein__Norovirus__BAG34650
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaaguguuauugaaucuagaguuggguccagaauuaaauccuuaucuggcacauuuagcaagaauguacaacggguaugccggugggauggaggugcaggucaugcuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguauugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6286 - RNA, 1629 nt, Artificial Sequence
  capsid_protein__Norovirus__BAG34652
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuagcccacagcaaauuaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguguugacuagacccuccccugacuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaccacaguacacuccaaaauugggucagauucaaauuggcacauggcaaaccgaugaucucacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaauaagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6287 - RNA, 1629 nt, Artificial Sequence
  capsid_protein__Norovirus__BAG34654
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguagaugcacacuggauggggagcuccaaggaacaacacaacuccaagucaguggcaucugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaucagcaaauagggggcacgacgcuguggucccuacuuacacaucacaguacacuccaaaauugggucagauucaaauuggcacauggcaaaccgaugaucuuacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6288 - RNA, 1629 nt, Artificial Sequence
  capsid_protein__Norovirus__BAG34656
augaagauggcgucgaaugacgccgcuccaucuacugauggugcagccggccucgugccagaaaguaauaaugaggucauggcccuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuucaagucaguggcauuugugcuuucaagggagaagugaccgcccauuugcaugacaaugaucaucuauacaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuauagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaacccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6289 - RNA, 1629 nt, Artificial Sequence
  capsid_protein__Norovirus__BAG34658
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcacgaauguacaacggguaugccggugggauggaggugcaggucauguuggcugggaaugcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaauaauuucuuucauuauaaucagaaagaugaucccaagaugagaauuguggcuaugcuuuacaccccccuuaggucuaaugguucaggugaugauguguuuacaguuuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugccuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6290 - RNA, 1629 nt, Artificial Sequence
  capsid_protein__Norovirus__BAG34662
augaagauggcgucgaaugacgccgcuccaucuacugauggugcagccggccucgugccagaaaguaacagugaggucauggcucuugagcccguggcuggugcugccuuggcagccccggucacuggucaaacaaauauuauagacccuuggauuagaucaaauuuuguccaggcccccaauggugaauuuacaguuucuccccguaaugccccuggugaagugcuauugaaucuagaguuggguccagaauuaaaccccuaucuggcacacuuggcaaggauguacaacggguaugccggugggauggaggugcaggucaugcuagcugggaaugcguucacugcugguaaauuggucuucgccgcugugccaccccacuucccgguugaaaaccuuagcccacagcaaauaacuauguucccucaugugauuauagaugucagaacuuuggaaccaguuuuauugccacucccugauguuaggaauaauuucuuccauuauaaccaaaaagaugacccuaagaugagaauuguggccauguuguacaccccucucagaucuaacgguucuggugaugacguguucacggucucauguaggguauugaccagacccuccccugauuuugauuuuacguaccuggugccaccaacaguggagucuaaaacaaaaccauucacccuuccaauccucacacuuggagagcuuuccaauucuagguuuccaguguccauagaucagauguauacuagccccaaugagguuauaucugugcagugccagaauggaagauguacacuggauggggagcuccaaggaacaacgcagcuccaagucaguggcauuugcgcauucaaaggagaagugacugcucauuuacagaaugaugaccaccuauauaauauuaccaucacaaaucugaaugggucccccuuugaucccuccgaggacauccccgccccccuaggcgugcccgacuuccagggaagaguuuuuggugucaucacucaaagagacaaacagaaugccacuggacaaaaccaaccggcaaacagggggcaugaugcuguaguucccacuuacacagcacaauacaccccaaaauugggucagauucagauaggcacauggcaaaccgacgaccuuaaggucaaccaaccggucaaauucacuccagucggccucaaugacacagaacacuucaaucagugggugguccccagguaugcuggugcuuuaaaccuaaacacaaaucuugccccuucagucgcgccaguauuuccgggggagcguuugcuuuucuucagaucauaccuaccccuuaagggugguuaugggaauccagccauugauugcuugcugccacaagaguggguacagcauuucuaucaggaagcagcacccucaaugagugagguggcccuugucagguacaucaacccggacacuggccgggcgcuguuugaggccaagcuccacagagcugguuucaugacggucucgagcaacacuagugcuccggugguugugccugccaacggauacuucagauuugauucuuggguuaaucaauuuuauucucuugcccccaugggaacuggaaaugggcguagaaggauucaguaa

SEQ ID NO: 6291 - RNA, 1629 nt, Artificial Sequence
  capsid_protein__Norovirus__BAG34664
augaagauggcgucgaaugacgccgcuccaucuacugauggugcagccggccucgugccagaaaguaauaaugagguuauggcucuugaacccguggcuggugccgccuuggcagccccggucaccggucaaacaaauauuauagacccuuggauuagagcaaauuuuguccaggccccuaauggugaauuuacaguuucuccccguaaugccccuggugaagugcuauugaaucuagaguuggguccagaauugaauccuuaucuggcacauuuagcaagaauguacaacggguaugcuggugggauggaggugcaggucauguuggcugggaacgcguucacagccggcaaauuggucuucgccgcugugccaccccauuucccgguugagaaucuuagcccacaacaaaucaccauguucccucaugugaucauagauguaaggacuuuggaaccuguuuuauuaccacucccugauguuagaaauaacuucuuucauuauaaucagaaagaugaucccaagaugagaauuguggccaugcucuacaccccccuuagguccaaugguucaggugaugauguguucacugucuccugcaggguguugaccagacccuccccugacuuugauuucacauaccuggucccaccaacaguggaauccaaaacaaaaccauucacucucccaauccucacacuuggggagcuuuccaauuccagauucccagugucuauagaccagauguacaccagccccaaugaaguuauaucuguacagugucaaaauggcaggugcacacuggauggggagcuucaaggaacaacgcaacuccaggucaguggcauuugugcauucaagggagaagugaccgcccauuugcaugacaaugaccaucuauauaauaucacuauuacaaaucugaaugguuccccuuuugaccccuccgaagacacccccgccccccugggcgugccugacuuccagggaagggucuuugguaucauuucucaaagagacaaacaaaaugccacuggacauaaugagccagcaaacaggggacacgaugcugugguucccacuuacacagcacaguacacuccaaaauugggucagauucaaauugguacauggcaaaccgaugaucucacagucaaccaaccagucaaauuuaccccaguuggucucaaugacacugaacacuuuaaccaguggguggucccuagauaugcuggugcuuuaaaucuaaacacaaaucuugccccuucuguugcaccaguguuuccaggggagcgccugcucuucuucaggucauacaucccccuuaagggugguuauggaaauccagccauugauugucuucugccacaagagugggugcagcauuuuuaucaggaagcagccccuucaaugagugagguggcccuugucagauacaucaauccggacacuggacgggcucuguuugaggccaagcuccacagagcugguuucaugacagucucgaguaacaccagugcuccgguagucgugccugccaauggauacuucagguuugacucuugggugaaccaguuuuauucucucgcccccaugggaacugggaaugggcguagaaggguucaguaa

SEQ ID NO: 6292 - RNA, 1629 nt, Artificial Sequence; identical to SEQ ID NO: 6281
  capsid_protein__Norovirus__BAG34666

SEQ ID NO: 6293 - RNA, 1629 nt, Artificial Sequence
  capsid_protein__Norovirus__BAG34668
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggauuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggagucuaaaacaaaacccuuuacccucccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6294 - RNA, 1629 nt, Artificial Sequence
  capsid_protein__Norovirus__BAG34670
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugagucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaaucaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacaguuuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaucaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcgugccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagccaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6295 - RNA, 1623 nt, Artificial Sequence
  capsid_protein__Norovirus__BAG55289
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccggaaaaaucauauuugcagcagucccaccaaacuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaguugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuaggcaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauaaucacaaugugcaccuggcccccgcuguagcccccacuuuuccgggugagcaacuucucuucuucagauccacuaugcccggaugcaguggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 6296 - RNA, 1629 nt, Artificial Sequence
  capsid_protein__Norovirus__BAG68707
augaagauggcgucgaaugacgccgcuccaucuacugauggugcagccggccucgugccagaaaguaauaaugaggucauggcucuugaacccguggcuggugccgcauuggcagccccggucaccggucaaacaaacauuauagauccuuggauuagagcaaauuucguccaggccccuaauggugaauucacaguuucuccccguaaugccccuggugaagugcuauuaaaucuagaguuagguccagaauugaauccuuaucuggcacauuuagcaagaauguauaacggguaugccggugggauggaggugcaggucauguuggcugggaacgcguucacagccggcaaauuggucuucgccgcugugccaccucauuucccgguugaaaaucuuaguccacaacaaauuaccauguucccucaugugauuauagauguaaggacuuuggaaccuguuuuauuaccacucccugauguuagaaauaacuucuuccauuauaaucagaaggaugaucccaagaugagaauuguggccaugcuuuacacuccccuuagguccaaugguucaggugaugauguguucacagucuccuguaggguguugaccaggcccuccccugauuuugauuucacauaccuagugccaccaacaguggaauccaagacaaaaccauucacccuuccaauccucacgcuuggggagcuuuccaauucuagauucccaguaucuauagaucagauguacaccagccccaaugaaguuauaucugugcagugucaaaauggcaggugcacacuggauggggagcuccaaggaacaacacaacuccaggucaguggcauuugugcauucaagggagaagugacugcccacuugcaugacaaugaucaucuauauaacaucacuaucacaaacuugaaugguuccccuuuugaccccuccgaggacauccccgcuccccugggcgugccugacuuccagggaagggucuuugguaucauuucucaaagagacaaacaaaaugccacuggacauaaugaaccagcaaacaggggacacgauguugugguucccacuuacacagcacaguauacuccaaaauugggccagauucaaauugguacauggcaaacugacgaucucacagucaaccaaccagccaaauuuaccccaguuggucucaaugauacugaacauuucaaccaguggguggucccuagauaugcuggagcuuuaaaucuuaacacaaaccuugcuccuucuguugcaccaguauuuccaggggagcgucugcucuucuucaggucauacaucccccuuaagggugguuauggaaacccagccauugauugucuucugccacaagagugggugcagcauuuuuaucaggaagcagccccuucaaugagugagguggcccuugucagauacaucaacccggacacuggucgggcucuguuugaggccaagcuccauagagcugguuucaugacagucucgagcaacaccagugcuccgguggucguaccugccaacggauacuucagguuugacucuugggugaaccaauuuuauucucucgcccccaugggaacugggaaugggcguagaaggguucaauaa

SEQ ID NO: 6297 - RNA, 1629 nt, Artificial Sequence
  capsid_protein__Norovirus__BAG68708
augaagauggcgucgaaugacgccgcuccaucuacugauggugcagccggccucgugccagaaaguaauaaugaggucauggcucuugaacccguggcuggugccgccuuagcagccccggucaccggucaaacaaauauuauagacccuuggauuagagcaaauuuuguccaggccccuaauggugaauuuacaguuucuccccguaaugccccuggugaagugcuauugaaucuagaguuagguccagaauugaauccuuaucuggcacauuuagcaagaauguauaauggguaugccggugggauggaggugcaggucauguuggcugggaacgcguucacagccggcaaauuggucuucgccgcugugccaccucacuucccgguugaaaaucuuaguccacaacaaauuaccauguucccucaugugauuauagauguaaggacuuuggaaccuguuuuauuaccacucccugauguuagaaauaacuucuuucauuacaaucagaaagaugauuccaagaugagaauuguggccaugcuuuauaccccccuuagauccaaugguucaggugaugauguguucacagucuccuguaggguguugaccagacccuccccugauuuugauuucacauaccuggugccaccaacaguggaauccaaaacaaaaccauucacccuuccaauccucacacuuggggagcuuuccaauucuagauucccagugucuauagaucagauguauaccagucccaaugaaguuauaucuguacagugucaaaauggcaggugcacucuggauggggagcuccaaggaacaacacaacuccagguuaguggcauuugugcauucaagggggaagugaccgcccauuugcaugacaaugaccaucuauauaacaucacuaucacaaacuugaaugguuccccuuuugaccccuccgaggacaucccugcuccccugggcgugccugacuuccagggaagggucuuugguaucauuucucaaagagacaaacaaaaugccacuggacacagugagccagcaaacaggggacacgaugcugugguuccuacuuacacagcacaguacaccccaaaauugggucagauucaaauugguacauggcagacugaugaucucacaguuaaccaaccagucaaauuuaccccaguuggucucaaugacacugaacacuuuaaccaguggguggucccuagguaugcuggugcuuuaaaucuuaacacaaaucuugccccuucuguugcaccaguguuuccaggggagcgccugcucuucuucaggucauacaucccccuuaagggugguuauggaaauccagccauugauugccuucugccacaagagugggugcaacacuuuuaucaggaagcagccccuucaaugagcgagguggcccuugucagauacaucaacccagacacuggccgggcucuguuugaggccaagcuccauagagcuggcuucaugacaguuucaagcaacaccagugcuccggugguugcaccugccaacggauacuucagguuugacucuugggugaaccaauuuuauucucucgcccccaugggaacuggaaaugggcguagaaggguucaguaa

SEQ ID NO: 6298 - RNA, 1629 nt, Artificial Sequence
  capsid_protein__Norovirus__BAG68709
augaagauggcgucgaaugacgccgcuccaucuacugauggugcagccggccucgugccagaaaguaauaaugaggucauggcucuugaaccaguggcuggugccgccuuagcagccccggucaccggucaaacaaauauuauagacccuuggauuagagcaaauuuuguccaggccccuaauggugaauuuacaguuucuccccguaaugccccuggugaagugcuauugaaucuagaguuagguccagaauugaauccuuaucuggcacauuuagcaagaauguauaauggguaugccggugggauggaggugcaggucauguuggcugggaacgcguucacagccggcaaauuggucuucgccgcugugccaccucacuucccgguugaaaaucuuaguccacaacaaauuaccauguucccucaugugauuauagauguaaggacuuuggaaccuguuuuauuaccacucccugauguuagaaauaauuucuuucauuauaaucagaaagaugaucccaagaugagaauuguggccaugcuuuacaccccccuuagauccaaugguucaggugaugauguguucacagucuccuguaggguguugaccaggcccuccccugauuuugauuucacauaccuggugccaccaacaguggaaucuaaaacaaaaccauucacccuuccaauccucacacuuggggagcuuuccaauucuagauucccagugucuauagaucagauguauaccagucccaaugaaguuauaucugugcagugucaaaauggcaggugcacucuggauggggagcuccaaggaacaacacaacuccaggucaguggcauuugcgcauucaagggagaagugacugcccauuugcacgauaaugaccaucuauauaacaucacuaucacaaacuugaaugguuccccuuuugaccccuccgaggacauccccgcuccccugggcgugccugacuuccagggaagggucuuugguaucauuucucaaagagacaaacaaaaugccacuggacauaaugagccagcaaacaggggacacgaugcugugguucccacuuacacagcacaguacaccccaaaauugggucagauucaaauugguacauggcaaaccgaugaucucacaguuaaccaaccagucaaauuuaccccaguuggucucaaugacacugaacacuuuaaccaguggguggucccuagauaugcuggugcuuuaaaucuuaacacaaaccuugccccuucuguugcaccaguguucccaggggagcgccugcucuucuucaggucauacaucccccuuaagggugguuaugggaauccagccauugauugucuucugccacaagagugggugcaacauuuuuaucaggaagcagccccuucaaugagugagguggcccuugucagauacaucaauccggacacuggccgggcuuuguuugaggccaagcuccauagagcugguuucaugacagucucaagcaacaccagugcuccggugguuguaccugccaacggauacuucagguuugacucuugggugaaccaauuuuauucucucgcccccaugggaacuggaaaugggcguagaaggguucaguaa

SEQ ID NO: 6299 - RNA, 1629 nt, Artificial Sequence
  capsid_protein__Norovirus__BAG68711
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguauaacggguaugccggugggauggaggugcaggucauguuggcugggaacgcguucacagccggcaaguuggucuucgccgcugugccaccucauuucccgguugaaaaucuuaguccacagcaaaucaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguguugaccagacccuccccugauuuugauuuuacauaucuggugccaccaacaguggaaucuaaaacaaaaccauuuacccuuccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccacuugcaugacaaugaucaccuauauaaugucaccaucacaaacuugaauggguccccuuuugaucccuccgaggacauccccgccccucugggcguaccugacuuucagggaagggucuuuggugucaucucccaaagagacaaacacauugccucuggacauaaugaaccagcaaacagaggacacgacgcuguggucccuacuuacacagcacaguacacuccaaaauugggucagauucaaauuggcacauggcagaccgacgaucuuacagucaaccaaccagucaaauucaccccaguuggacucaaugacacugaccauuuuaaccaaugggugguccccagauaugcuggugcucuaaaccuuaacacaaaccuugccccuucuguugcuccaguauuuccaggggagcgucugcucuuuuucagaucauacaucccccucaagggugguuauggaaauccagccauugauugccuacuaccacaagagugggugcaacauuucuaucaggaaucagccccuucaaugagugagguggcccuugucagauacauuaacccggacacuggccgggcacuguuugaggccaagcuccacagagcugguuucaugacagucucaagcaacaccagugcuccggugguugugccugccaacggauacuucagauuugauucuuggguaaaccaauucuauucucucgcccccaugggaacuggaaaugggcguagaaggacucaauaa

SEQ ID NO: 6300 - RNA, 1629 nt, Artificial Sequence
  capsid_protein__Norovirus__BAG68712
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaacgccccuggugaagugcuauugaaucuagaguuggguccagaauuaaauccuuaucuggcacacuuagcaagaauguauaacggguaugccggugggauggaggugcaggucauguuggcugggaacgcguucacagccggcaaguuggucuucgccgcugugccaccucauuucccgguugaaaaccuuaguccacagcaaauuaccauguucccucaugugauuauagauguaaggacuuuggaaccuguuuuauuaccacucccugauguuagaaauaauuucuuccauuauaaucagaaagaugaucccaagaugagaauuguggcuaugcuuuacaccccccuuaggucuaaugguucaggugaugauguguuuacagucuccugcaggguguugacuagacccuccccugauuuugauuuuacauaucuggugccaccaacaguggaaucuaaaacaaaaccauuuacccucccaauccucacacuuggggaacuuuccaauucuagauucccaguguccauagaucagauguacaccagccccaaugaaguuauaucagugcagugccaaaaugguaggugcacacuggauggggagcuccaaggaacaacacaacuucaagucaguggcauuugugcuuuuaagggagaagugaccgcccacuugcaugacaaugaucaccuauauaaugucaccaucacaaacuugaauggguccccuuuugaucccuccgaggacaucccugccccucugggcguaccugacuuucagggaagggucuuuggugucaucucccaaagagacaaacacaaugccucuggacauaaugaaccagcaaacaggggacacgacgcuguggucccuacuuacacagcacaguacacuccaaaauugggucagauucaaauuggcacauggcagaccgacgaucuuacagucaaccaaccagucaaauucaccccaguuggacucaaugacacugaacauuuuaaccaaugggugguccccagauaugcuggugcucuaaaccuuaauacaaaucuugccccuucuguugcuccaguguuuccaggggagcgccugcucuuuuucagaucauacaucccccucaagggugguuauggaaacccagccauugauugccuacuaccacaagagugggugcaacauuucuaucaggaagcagccccuucaaugagugagguggcccuugucagauacaucaacccggacacuggucgggcacuguuugaggcuaagcuccacagagcugguuucaugacagucucaagcaacaccagugcuccggugguugugccugccaacggauacuucagauuugauucuugggugaaucaauucuauucucucgcccccaugggaacuggaaaugggcguagaaggguucaauaa

SEQ ID NO: 6301 - RNA, 1629 nt, Artificial Sequence
  capsid_protein__Norovirus__BAG68713
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcgaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucauuucccgguugaaaaccuuaguccacagcaaaucaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccucuuaggucuaaugguucaggugaugauguguuuacagucuccugcaggguguugacuagacccucccccgauuuugauuuuacauaucuggugccaccaacaguggaaucuaaaacaaaaccauuuacccuuccaauccucacacuuggggaacuuuccaauucuagauucccaguguccauagaccagauguacaccagccccaaugaagucauaucagugcagugucaaaaugguaggugcacgcuagauggggagcuccaaggaacaacacaacuccaagucaguggcauuugugcuuucaagggagaaguaaccgcccacuugcaugauaaugaucaccuauauaaugucaccaucacaaacuugaauggguccccuuuugaucccuccgaggacauccccgccccucugggcguaccugacuuucagggaagggucuuuggugucaucucccaaagagacaaacacaaugccucuggacauaaugaaccagcaaacagaggacacgacgcuguggucccuacuuacacagcacaguacacuccaaaauugggucagauccaaauuggcacauggcagaccgacgaucuuacagucaaccaaccagucaaauucaccccaguuggacucaaugacacugaacauuuuaaccaaugggugguccccagauaugcuggugcucuaaaccuuaacacaaaccuugccccuucuguugcuccaguauuuccaggggagcgccugcucuuuuucagaucauauaucccccucaagggugguuauggaaauccagccauugauugccuacuaccacaagagugggugcaacauuucuaucaggaagcagccccuucaaugagugagguggcccuugucagauacaucaacccggacacuggucgggcacuguuugaggccaagcuccacagagcugguuucaugacagucucaagcaacaccagugcuccggugguugugccugccaacggauacuucagauuugauucuugggugaaccaauucuauucucucgcccccaugggaacuggaaaugggcguagaaggguucaauaa

SEQ ID NO: 6302 - RNA, 1629 nt, Artificial Sequence
  capsid_protein__Norovirus__BAG68714
augaagauggcgucgaaugacgccgcuccaucuacugauggugcagccggccucgugccagaaaguaguaaugagguuauggcucuugaacccguggcuggugccgccuuggcagccccggucaccggucaaacaaauauuauagacccuuggauuagagcaaauuuuguccaggcccccaauggugaauuuacagucuccccccguaaugccccuggugaagugcuauugaaucuagaguuggguccagaauugaauccuuaucuggcacacuuagcaagaauguacaacggguaugccggugggauggaggugcaggucauguuggcugggaacgcguucacugccggcaaguuggucuucgccgcugugccaccucauuucccgguugaaaaccuuagcccacagcaaauuaccauguucccucaugugauuauagauguaaggacuuuggaaccuguuuuauuaccacucccugaugucagaaauaauuucuuucauuauaaucagaaagaugaucccaagaugagaauuguagcuaugcuuuauaccccccucaggucuaaugguucaggugaugauguguuuacagucuccugcaggguguugacuagacccuccccugauuuugauuuuacauaccuggugccaccaacaguggaaucuaaaacaaaaccauucacccucccaauccucacacuuggagaacuuuccaacucuagauucccaguguccauagaccagauguacaccagccccaaugaagucauaucagugcagugucaaaaugguaggugcacacuggauggggagcuccaaggaacaacacaacuccaagucaguggcauuugugcuuucaagggagaaguaaccgcccacuugcaugacaaugaucaccuauauaaugucaccaucacaaacuugaauggguccccuuuugaucccuccgaggacauccccgccccucugggcgugccugacuuucaggggagggucuuuggugucaucucccaaagagacaaacacaaugccucuggacauaaugagccagcaaacagaggacaugacgcuguggucccuacuuacacagcacaguacacuccaaaauugggucagguucaaauuggcacauggcagaccgacgaucuuacagucaaccaaccagucaaauucaccccaguugggcucaaugacacugaacauuuuaaccaaugggugguccccagauaugcuggugcucuaaaccuuaacacaaaccuugccccuucuguugcuccaguguuuccaggggagcgucugcucuuuuucagaucauacaucccccucaagggugguuauggaaauccagccauugacugccuacuaccacaagagugggugcaacauuucuaucaggaagcagccccuucaaugagugagguggcccuugucagauacaucaacccggacacuggucgagcauuguuugaggccaagcuccacagagcugguuucaugacagucucaagcaacaccagugcuccggugguugugccugccaacggauacuucagauuugauucuugggugaaccaauucuauucucucgcccccaugggaacuggaaacgggcguagaaggguucaauaa

SEQ ID NO: 6303 - RNA, 1629 nt, Artificial Sequence
  capsid_protein__Norovirus__BAG68715
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauucacagucucuccccguaaugccccuggugaagugcuauugaaucuagaguuggguccagaauuaaauccuuaucuggcacauuuagcaagaauguacaacggguaugccggugggauggaggugcaggucaugcuggcugggaacgcguucacagccggcaaguuggucuucgccgcugugccaccucacuucccgguugaaaaccuuaguccacagcaaauuaccauguucccucaugugauuauagauguaaggaccuuggaaccuguuuuauuaccacucccugauguuagaaauaauuucuuccauuauaaucagaaagaugaucccaagaugagaauuguggcuaugcuuuacaccccccuuaggucuaauggcucaggugaugauguguuuacagucuccugcaggguguugacuagacccuccccugauuuugauuucacauaucuggugccaccaacaguggaaucuaaaacaaaaccauucacccucccaauccucacacuuggggaacucucuaauucuagauucccaguguccauagaccagauguacaccagccccaaugaaguuauaucagugcagugucaaaaugguaggugcacacuggauggggagcuccaagggacaacacaacuccaagucaguggcauuugugcuuucaagggagaagugaccgcccacuugcaugacaaugaucaccuauauaaugucaccaucacaaacuugaauggguccccuuuugaccccuccgaggacaucccugccccucuggguguaccugacuuucagggaagggucuuuggugucaucucccaaagagacaagcacaauagcccuggacauaaugaaccagcaaacaggggacacgacgcuguggucccuacuuacacagcacaguacacuccaaaauugggucagauucaaauuggcacauggcagacugacgaucuuacagucaaccaaccagucaaauucaccccaguuggacucaaugacacugaacauuuuaaccaaugggugguccccagauaugcuggugcccuaaaccucaauacaaaccuugccccuucuguugcuccaguauuuccaggggagcgcuugcucuuuuucagaucauacauuccccucaagggugguuauggaaauccagccauugauugccuacuaccacaagagugggugcagcauuucuaucaggaagcagccccuucaaugagugagguggcccuugucagauacaucaacccggauaccggucgggcacuguuugaggccaagcuccacagagcugguuucaugacagucucaagcaacaccagugccccggugguugugccugccaauggauacuucagauuugauucuugggugaaccaauucuauucucucgcccccaugggaacuggaaaugggcguagaaggguucaauaa

SEQ ID NO: 6304 - RNA, 1629 nt, Artificial Sequence
  capsid_protein__Norovirus__BAG68716
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucaugcuggcugggaacgcguucacagccggcaaguuggucuucgccgcugugccaccucacuucccgguugaaaaccuuaguccacagcaaauuaccauguucccucaugugauuauagaugugaggaccuuggaaccuguuuuauuaccacucccugauguuagaaacaauuucuuccacuauaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccaccaacaguggaaucuaaaacaaaaccauucacccucccaauccucacacuuggggaacucucuaauucuagauucccaguguccauagaccagauguacaccagccccaaugaaguuauaucagugcagugucaaaaugguaggugcacacuggauggggaacuccaagggacaacacaacuacaagucaguggcauuugugcuuucaagggagaagugaccgcccacuugcaugacaaugaucaccuauauaaugucaccaucacaaacuugaauggguccccuuuugaccccuccgaggacaucccugccccucugggugugccugacuuucaaggaaggguuuuugguaucaucucccaaagagacaaacacaauagcccuggacauaaugaaccagcaaacaggggacacgacgcuguagucccuacuuacacagcacaguacacuccaaaauugggucagauucaaauuggcacauggcagaccgacgaucuuacagucaaccaaccaguuaaauucaccccaguuggacucaaugauacugaacauuuuaaccaaugggugguucccagauaugcuggugcccuaaaccucaacacaaaccuugccccuucuguugcuccaguauuuccaggggagcgccugcucuucuucagaucauacauuccccucaagggugguuauggaaauccagccauugauugccuacuaccacaagagugggugcaacauuucuaucaggaagcagccccuucaaugagugagguggcccuugucagauacaucaacccggauacuggucgggcacuguuugaggccaagcuccacagagcuggcuucaugacagucucaagcaacaccagugccccggugguugugccugccaauggauacuucagauuugauucuugggugaaccaauucuauucucucgcccccaugggaacuggaaaugggcguagaaggguucaauaa

SEQ ID NO: 6305 - RNA, 1647 nt, Artificial Sequence
  capsid_protein__Norovirus__BAG68799
augaagauggcgucgaaugacgccgcuccaucuaaugauggugccgccggccucgucccagagaucaacaaugaggcaauggcgcuagagccaguggcgggugcagcgauagcagcaccccucacuggucagcaaaauauaauugaucccuggauuaugaauaauuuugugcaagcaccugguggugaguuuacaguauccccuagaaauuccccuggugaaguucuucuuaauuuggaacugggcccagaaauaaaucccuauuuggcccaucuugcuagaauguauaaugguuaugcagguggauuugaagugcaggugguccuagcuggaaaugcguuuacagcaggaaagauaaucuuugcagcuauuccccccaauuuuccaauugacaaucuaagugcagcacagaucacaauguguccacaugugauuguggaugucagacaguuggaaccagucaaccucccgaugccugacguucgcaacaacuucuuucauuacaaccaagggucugauucgagauugcgccuaauugcaaugcuauacacaccucuuagggcaaauaauucuggggaugauguuuuuacugugucuugcagagugcuaacuagaccuagcccugacuucucauuuaauuuccuugugccacccacuguggagucaaagacaaaacccuuuucccucccuauucugacuaucucugaaauguccaauucuagguucccaguaccaauugauucucugcacaccagcccuacugagaauauuguuguccagugccagaaugggcgcgucacccuugauggugaguugaugggcaccacccaacucuuaccuagccaaauuugugcuuucaggggcgugcucaccagaucaacaagcagggccagugaccaggccgauacagcaaccccuagauuguuuaauuauuauuggcauauacaauuggauaaucuaaauggaacuccuuaugauccugcagaagacauaccaggcccccuagggacaccagauuuccggggcaaagucuuuggcguggccagccagagaaauccugaugccacgacuagggcacaugaagcaaagauagacacagcaucuggccguuucaccccaaaacuaggcucauuagagauauccacugaaucugaugauuuugaccaaaacaaaccaacaagauucaccccaguuggcauugggguugaccaugaggaagacuuucaacaauggacucuacccgacuaugcuggccaguucacccacaacaugaacuuagccccagcuguugcucccaacuucccuggugagcagcuccuuuucuuccgcucacaguugccaucuucuggugggcgauccaacgggauucuagacugccuggucccccaagaauggguacagcacuucuaccaagaaucagcccccucccaaucucaaguggcccugguuagguauaucaacccugacacugguagaguguuauuugaggccaagcugcacaaauuagguuucaugacuauagccaagaauggugacucuccaauaacugucccuccgaauggauacuuuagguuugaaucuugggugaaccccuuuuauacacuugcccccaugggaacugggaaugggcguagaaggauucaauaa

SEQ ID NO: 6306 - RNA, 1647 nt, Artificial Sequence
  capsid_protein__Norovirus__BAG68800
augaagauggcgucgaaugacgccgcuccaucuaaugauggugccgccggccucgucccagagaucaacaaugaggcaauggcgcuagagccaguggcgggugcagcgauagcagcaccccucacuggucagcaaaauauaauugaucccuggauuaugaauaauuuugugcaagcaccugguggugaguuuacaguauccccuagaaauuccccuggugaaguucuucuuaauuuggaacugggcccagaaauaaaucccuauuuggcccaucuugcuagaauguauaaugguuaugcagguggauuugaagugcaggugguccuagcuggaaaugcguuuacagcaggaaagauaaucuuugcagcuauuccccccaauuuuccaauugacaaucuaagugcagcacagaucacaauguguccacaugugauuguggaugucagacaguuggaaccagucaaccucccaaugccugacguucgcaacaccuucuuucauuacaaccaagggucugauucgagauugcgccuaauugcaaugcuauacacaccucuuagggcaaauaauucuggggaugauguuuuuacugugucuugcagagugcuaacuagaccuagcccugacuucucauuuaauuuccuugugccacccacuguggagucaaagacaaaacccuuuucccucccuauucugacuaucucugaaauguccaauucuagguucccaguaccaauugauucucugcacaccagcccuacugagaauauuguuguccagugccagaaugggcgcgucacccuugauggugaguugaugggcaccacccaacucuuaccuagccaaauuugugcuuucaggggcgugcucaccagaucaacaagcagggccagugaccaggccgauacagcaaccccuagauuguuugauuauuauuggcauauacaauuggacaaucuaaauggaacucccuaugauccugcagaagacauaccaggcccccuagggacaccagauuuccggggcaaagucuuuggaguggccagccagagaaauccugauaccacgacuagggcacaugaagcaaaaauagacacagcaucuggccguuucaccccaaaacuaggcucauuagagauauccacugaaucugaugauuuugaccaaaacaaaccaacaagauucaccccaguuggcauugggguugaccaugaggaagacuuucaacaauggacucuacccaacuaugcuggccaguucacccacaacaugaacuuagccccagcuguugcucccaacuucccuggugagcagguccuuuucuuccgcucacaguugccaucuucuggugggcgauccaacgggauucuagacugccuggucccccaagaauggguacagcacuucuaccaagaaucagcccccucccaaucucaaguggcccugguuagguaugucaacccugacacugguagaguguuauuugaggccaagcugcacaaauuagguuucaugacuauagccaggaauggugacucuccaauaacugucccuccgaauggauacuuuagguuugaaucuugggugaaccccuuuuauacacuugcccccaugggaacugggaaugggcguagaaggauucaauaa

SEQ ID NO: 6307 - RNA, 1623 nt, Artificial Sequence
  capsid_protein__Norovirus__BAG68801
augaagauggcgucgaaugacgccaccccaucugauggguccacagccaaccucgucccagaggucaacaaugagguuauggcuuuggagcccguuguuggcgccgcgauugcggcaccuguagcgggccaacaaaauguaauugaccccuggauuagaaauaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucauuacaaucaaucaaaugaccccaccaucaaauugauagcaaugcuguauacaccacuuagggcuaacaaugcuggggacgaugucuucacagucucuugucgaguucucacgaggccaucccccgauuuugauuucauauuuuuggugccacccacaguugagucaagaacuaaaccauucucugucccaaucuuaacuguugaggagaugaccaauucaagauucccuauuccuuuggaaaaguuguuuacgggucccagcagugccuuuguuguccaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaggauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagauucaccccagucggugucguccaggauggcaguaccacccaccaaaaugaaccccaacaaugggugcucccagauuauucagguagagauagucacaauguacaccuagccccugccguggcccccacuuuuccgggugagcaacuucuuuucuuuagguccaccaugcccggaugcagcggguaucccaacaugaauuuggauugccuacucccccaggagugggugcaacacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6308 - RNA, 1623 nt, Artificial Sequence
  capsid_protein__Norovirus__BAG68802
augaagauggcgucgaaugacgccaccccaucugauggguccacagccaaccucgucccagaggucaacaaugagguuauggcuuuggagcccguugcuggcgccgcgauugcggcaccuguagcgggccaacaaaauguaauugaccccuggauuagaaacaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaacaauuucuaucauuacaaucaaucaaaugaccccaccaucaaauugauagcaaugcuguauacaccacuuagggcuaacaaugcuggggacgaugucuucacagucucuugucgaguucucacgaggccaucccccgauuuugauuucauauuuuuggugccacccacaguugagucaagaacuaaaccauucucugucccaaucuuaacuguugaggagaugaccaauucaagauucccuauuccuuuggaaaaguuguuuacgggucccagcagugccuuuguuguccaaccacaaaauggcagaugcacgacugauggcgugcucuuagguacuacccaacugucuccugucaacaucugcaccuucagaggggaugucacccacauugcaaauacucaaaauuacacaaugaaucuggccucccaaaauuggaacaauuaugacccaacagaagaaaucccagccccucugggaaccccagauuuuguaggaagaauccaaggcgugcucacccaaaccacaaggggggauggcucgacccgcggucacaaagccacagugagcacuggaaguguccacuuuaccccaaagcugggcaguguucaauucuccacugauacaagcaaugaccuugaaacuggccaaaacacgagauucaccccagucggugucguccaggauggcgguaccacccaccgaaaugaaccccaacaaugggugcucccagauuauucagguagagauagucacaauguacaccuagccccugccguggcccccacuuuuccgggugagcaacuucuuuucuuuagguccaccaugcccggaugcagcggguaucccaacaugaauuuggauugccuacucccccaggagugggugcaacacuucuaucaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6309 - RNA, 1623 nt, Artificial Sequence
  capsid_protein__Norovirus__BAG68803
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaaggaagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaucgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagauuugauuccuggguuaaucaauucuacacacuugcccccaugggaaauggaacggggcguagacgugcuuuauaa

SEQ ID NO: 6310 - RNA, 1623 nt, Artificial Sequence
  capsid_protein__Norovirus__BAG68804
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaucgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagauuugauuccuggguuaaucaauucuacacacuugcccccaugggaaauggaacggggcguagacgugcuuuauaa

SEQ ID NO: 6311 - RNA, 1623 nt, Artificial Sequence
  capsid_protein__Norovirus__BAG68805
augaagauggcgucgagugacgccaacccaucugauggguccacagccaaccucgucccagaggucaacaaugagguuauggcuuuggagcccguuguuggugccgcuauugcggcaccuguagcgggccaacagaauguaauugaccccuggauuagaaauaauuuuguacaagccccugguggagaguuuacaguauccccuagaaacgcuccaggugaaauacuauggagcgcgccccugggcccugauuugaaucccuaccuuucccauuuggcuagaauguacaauaguuaugcaggugguuuugaagugcagguaauccucgcggggaaugcguucaccgccggaaaaaucguauuugcagcagucccaccaaauuucccaacugaaggcuugagccccagccaggucacuauguucccccacauaauaguagauguuaggcaacuggaaccuguguugaucccuuuacccgauguuaggaauaauuucuaucacuauaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaauggcaggugcacgacugauggcgugcucuuagguacuacccaacugucuccugucaacaucuguaccuucagaggggaugucacccacauugcugguacucaagaauacacaaugaaucuggccucccaaaacuggaacaauuaugacccaacagaagaagucccagccccucugggaacuccagauuucauggguaagauccaaggcgugcucacccaaaccacaaggagggauggcucgacccgcggucacaaagccacagugagcacuggaaguguccacuucaccccaaagcugggcagaauucaauucuccaccgauacaaguaaugauuuugaaacuggccaaaacacgagauucaccccagucgguguuguccaggaugguaguaccacccaccaaaaugaaccccaacaauggguacucccaaauuauucagguagagauagccacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaguccagacacagguaggguucuguuugaguguaagcuucacaaaucaggcuaugucacaguggcucacacuggccaacaugauuuaguuaucccccccaauggcuauuuuagauuugauuccugggucaaccaguucuacacacuugcccccaugggaaauggaacggggcguagacgugcauuauaa

SEQ ID NO: 6312 - RNA, 1623 nt, Artificial Sequence
  capsid_protein__Norovirus__BAG68806
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgccccugggcccugauuugaaucccuaccuuucccauuuggccagaauguacaaugguuaugcaggugguuuugaagugcagguaauccucgcggggaacgcguucaccgccggaaaaaucguauuugcagcagucccaccaaauuucccaacugaaggcuugagccccagccaggucacuauguucccccauauaauaguagaugucaggcaacuggaaccuguguugaucccuuuacccgauguuaggaauaauuucuaucacuacaaucaaucaaaugacuccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuauuguucaaccacaaaauggcaggugcacgacugauggcgugcucuuagguacuacccaacugucuccugucaacaucuguaccuucagaggggaugucacccacauugcugguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccaccgauacaaguaaugauuuugaaacuggccaaaacacgagauucaccccagucgguguuguccaggaugguaguaccacccaccaaaaugaaccccaacaauggguacucccaaauuauuuagguagagauagccacaaugugcaccuagccccugccguggcccccucuuuuccgggugagcaacuucuuuucuucagguccacuaugcccggaugcagcggguaucccaacaugaauuuggauugucuacucccccaggaaugggugcagcacuucuaccaagaggcagccccagcacaaucugauguggcucugcuaagauuugugaauccagacacagguaggguucuguuugaguguaagcuucacaaaucaggcuaugucacaguggcucacacuggccaacaugauuuaguuaucccccccaauggcuauuuuagauuugauuccugggucaaccaguucuacacacuugcccccaugggaaauggaacggggcguagacgugcauuauaa

SEQ ID NO: 6313 - RNA, 1647 nt, Artificial Sequence
  capsid_protein__Norovirus__BAG68807
augaagauggcgucgagugacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaauuuugugcaagcaccugguggugaguuuacaguguccccuaggaauuccccuggugaagugcuucuuaauuuggaauugggcccagaaauaaaucccuauuuggcucaucuugcuagaauguauaaugguuaugcagguggauuugaagugcagguaguccuagcuggaaaugcguuuacagcaggaaagauaaucuuugcagcuauacccccuaacuuuccaauugauaauuugagugcagcacagaucacaaugugcccacauguaauuguggaugucagacaguuggaaccggucaaccucccgaugccugacguucgcaacaacuucuuucauuauaaucaagggucugauucgagauugcgcuuaauugcaaugcuguauacaccucuuagggcaaauaauucuggggaugauguuuuuacugugucuuguagagugcugacuaggccuagcccugacuuuucauuuaauuuccuugugccaccuacuguggagucaaagacaaaacccuucacccucccuauucugacuaucucugaaauguccaauucuagguuuccagugccgaucgacucucugcacaccagcccaacugagaauauuguuguccagugccaaaaugggcgcgucacucuugauggugaguugaugggcaccacccaacucuuaccuagucaaauuugugcuuuuaggggcgugcucaccagaucaacaagcagggccagugaccaagccgauacagcaaccccuagauuguuuaauuauuauuggcacauacaauuggauaaucuaaaugggacuccuuaugacccugcagaagacauaccaggcccccuggggacaccagauuuucggggcaaggucuuuggcguggccagccagagaaaucccgacaguacaacuagagcacaugaggcaaagguggacacaacagcuggucguuucaccccaaaacuaggcucauuagagauauccacugaaucugaugacuuugaucaaaaccaaccaacaagauucaccccaguuggcauugggguugaccaugaggcagacuuccaacaauggucuuuacccgacuauucuggucaguucacccacaacaugaacuuagccccagcuguugcucccaacuuuccuggugaacaacuccuuuucuuccgcucacagcuaccauccucuggugggcgauccaacgggauucuagacugcuuggucccccaagaauggguucagcacuucuaccaagaaucggcccccgcccaaacucaaguggcccugguuagguaugucaacccugacacugguagaguauuauuugaggccaagcugcacaaauuagguuucaugacuauagcuaagaauggugauucuccaauaacugucccuccaaauggguacuuuagguuugaaucuugggugaaccccuuuuauacucuugcccccaugggaacugggaaugggcguagaaggauucaauaa

SEQ ID NO: 6314 - RNA, 1623 nt, Artificial Sequence
  capsid_protein__Norovirus__BAG68808
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauucgcagcagucccaccaaacuucccaacugaaggcuugagccccagccaggucacuauguucccccauauaauaguagauguuaggcaacuggaaccuguguugauccccuugccugauguuaggaauaauuucuaucauuacaaucagucaaaugaccccaccaucaaauugauagcaaugcuguauacaccacuuagggcuaacaaugcuggggacgaugucuucacagauucuugucgaguucucacgagaccaucccccgauuuugauuucauauuuuuggugccacccacaguugagucaaggacuaaaccauuuucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguaccacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucuccacugauacaagcaaugaccuugaaaccggccaaaacacgagauucaccccagucggugucguccaggaugguaguaccacucaccaaaaugaaccccaacaaugggugcucccagacuauucagguagagacagucacaauguacaccuagccccugccguggcucccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcgcugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuguaa

SEQ ID NO: 6315 - RNA, 1623 nt, Artificial Sequence
  capsid_protein__Norovirus__BAG68809
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauucgcagcagucccaccaaacuucccaacugaaggcuugagccccagccaggucacuauguucccccauauaauaguagauguuaggcaacuggaaccuguguugauccccuugccugauguuaggaauaauuucuaucauuacaaucagucaaaugaccccaccaucaaauugauagcaaugcuguauacaccacuuagggcuaacaaugcuggggacgaugucuucacagauucuugucgaguucucacgagaccaucccccgauuuugauuucauauuuuuggugccacccacaguugagucaaggacuaaaccauuuucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguaccacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggggggauggcucgacccgcggucacaaagccacagugagcacuggaaguguccacuuuaccccaaagcugggcaguguucaauucuccacugauacaagcaaugaccuugaaaccggccaaaacacgagauucaccccagucggugucguccaggaugguaguaccacucaccaaaaugaaccccaacaaugggugcucccaaacuauucagguagagacagucacaauguacaccuagccccugccguggcucccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcgcugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuguaa

SEQ ID NO: 6316 - RNA, 1623 nt, Artificial Sequence
  capsid_protein__Norovirus__BAG68810
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaaugaccccaccaucaaauugauagcaauguuguauacaccacuuagggcuaauaaugcuggggaugaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcugguacccaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucucuacugauacaagcaaugauuuugaaacuggccaaaacacgagauucaccccagucgguguuguccaggaugguaguaccacccaccaaaaugaaccccaacaauggguacucccaaauuauucagguagagauggccacaaugugcaccuagccccugccguggcccccucuuuuccgggugagcaacuucucuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6317 - RNA, 1623 nt, Artificial Sequence
  capsid_protein__Norovirus__BAG68811
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaaugaccccaccaucaaauugauagcaauguuguauacaccacuuagggcuaauaaugcuggggaugaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcuaauacccaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucucuacugauacaagcaaugauuuugaaacuggccaaaacacgagauucaccccagucgguguuguccaggaugguaguaccacccaccaaaaugaaccccaacaauggguacucccaaauuauucagguggagauggccacaaugugcaccuagccccugccguggcccccucuuuuccgggugagcaacuucucuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6318 - RNA, 1623 nt, Artificial Sequence
  capsid_protein__Norovirus__BAG68812
augaagauggcgucgagugacgccaacccaucugauggauccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucauuacaaucaaucgaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccaguagugccuuuguuguucaaccacaaaauggcaggugcacgacugauggcgugcucuuagguacuacccaacugucuccugucaacaucugcaccuucagaggggaugucacccacauugcugguacucaagaauacacaaugaaccuggccucccaaaacuggaacaauuaugacccaacagaagaaaucccagccccucugggaacuccagauuucguggguaagauccaaggcgugcucacccaaaccacaagaagggauggcucgacccgcggucacaaagccacagugagcacuggaaguguccacuucaccccaaagcugggcagaauucaauucuccacugauacaagcaaugauuuugaaacuggucaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuacacacuugcccccaugggaaauggaacggggcguagacgugcauuauaa

SEQ ID NO: 6319 - RNA, 1623 nt, Artificial Sequence
  capsid_protein__Norovirus__BAG68813
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuguccagaauguacaauaguuaugcaggugguuuugaagugcagguaauccucgcggggaacgcguucaccgccggaaaaaucauauuugcagcagucccaccaaauuucccaauugaaggcuugagccccagccaggucacuauguucccccauauaauaguagauguuaggcaacuggaaccuguguugaucccuuuacccgauguuaggaauaauuucuaucauuacaaucaaucgaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccacuccuguggaaaaguuguucacgggucccaguagugccuuuauuguucaaccacaaaauggcaggugcacgauugauggcgugcucuuagguacuacccaacugucuccugucaacaucugcaccuucagaggggaugucacccacauugcugguacucaagaauacacaaugaaccuggccucccaaaacuggaacaauuaugacccaacagaagaaaucccagccccucugggaacuccagauuucguggguaagauccaaggcgugcucacccaaaccacaagaagggauggcucgacccgcggucacaaagccacagugagcacuggaaguguccacuucaccccaaagcugggcagaauucaauucuccacugauacaagcaaugauuuugaaacucgucaaaacacgagauucaccccagucgguguuauccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguuauguuugaguguaagcuccauaaaucaggcuauaucacaguggcucacacuggccaacaugauuuaguuaucccccccaauggcuauuuuagauuugaugccugggucaaccaguucuacacacuugcccccaugggaaauggaacggggcguagacgugcauuauaa

SEQ ID NO: 6320 - RNA, 1647 nt, Artificial Sequence
  capsid_protein__Norovirus__BAG68814
augaagauggcgucgaaugacgccgcuccaucuaaugauggugccgccggccucgucccagagaucaacaaugaggcaauggcgcuagagccaguggcgggugcagcgauagcagcaccccucacuggucagcaaaauauaauugaucccuggauuaugaauaauuuugugcaagcaccugguggugaguuuacaguguccccuagaaauuccccuggugaaguccuucuuaauuuggaauugggcccagaaauaaaucccuauuuggcccaucuugcuagaauguauaaugguuaugcagguggauuugaagugcaggugguccuagcuggaaaugcguuuacagcaggaaagauaaucuuugcagcuaucccccccaauuuuccaauugacaaucuaagugcagcacagaucacaaugugcccacaugugauuguggaugucagacaguuggaaccagucaaccucccgaugccugacguucgcaacaacuucuuucauuacaaucaagggucugauucgagauugcgccuaauugcaaugcuauacacaccucuuagggcaaauaauucuggggaugauguuuuuacugugucuugcagagugcuaacuagaccuaguccugacuucucauuuaauuuccuugugccaccuacuguggagucaaagacaaaacccuucucccucccuauucugacuaucucugaaauguccaauucuagguucccaguaccaauugauucucugcacaccaguccuacugagaauauuguuguccagugccagaaugggcgcgucacccuugauggugaguugaugggcaccacccaacucuuaccuagccaaaucugugcuuucaggggcguucucaccagaucaacaagcagggccagugaccaggccgauacagcaaccccuagauuauuuaauuauuauuggcauauacaauuggauaaucuaaauggaacuccuuaugauccugcagaagacauaccaggcccccuagggacaccagauuuccggggcaaagucuuuggcguggccagccagagaaauccugauaccacgacuagggcacaugaagcaaagauagacacaacaucuggccguuucaccccaaaacuaggcucacuagagauauccacugaaucugaugauuuugaucaaaacaaaccaacaagauucaccccaguuggcauugggguugaccgugagguagacuuucaacaaugggcucuacccgacuacgcuggucaguucacccacaacaugaacuuagccccagcuguugcucccaacuucccuggugaacagcuccuuuucuuccgcucacaguugccaucuucuggugggcgauccaacgggauuuuagacugccuggucccccaagaauggguacagcacuucuaccaagaaucagcccccucccaaucucaaguggcccugguuagguauaucaacccugacacugguagaguguuauuugaggccaagcugcauaaauuagguuucaugacuauagccaagaauggugacucuccaauaacugucccuccaaauggauacuuuagguuugaaucuugggugaaccccuuuuauacacuugcccccaugggaacugggaaugggcguagaaggauucaauaa

SEQ ID NO: 6321 - RNA, 1647 nt, Artificial Sequence
  capsid_protein__Norovirus__BAG68815
augaagauggcgucgaaugacgccgcuccaucuaaugauggugccgccggccucgucccagagaucaacaaugaggcaauggcgcuagagccaguggcgggugcagcgauagcagcaccccucacuggucagcaaaauauaauugaucccuggauuaugaauaauuuuguacaagcaccugguggugaguuuacaguguccccuagaaauuccccuggugaaguccuucuuaauuuggaauugggcccagaaauaaaucccuauuuggcccaucuugcuagaauguauaaugguuaugcagguggauuugaagugcaggugguccuagcuggaaaugcguuuacagcaggaaagauaaucuuugcagcuaucccccccaauuuuccaauugacaaucuaagugcagcacagaucacaaugugcccacaugugauuguggaugucagacaguuggaaccagucaaccucccgaugccugacguucgcaacaacuucuuucauuacaaucaagggucugauucgagauugcgccuaauugcaaugcuauacacaccucuuagggcaaauaauucuggggaugauguuuuuacugugucuugcagagugcuaacuagaccuaguccugacuucucauuuaauuuccuugugccaccuacuguggagucaaagacaaaacccuucucccucccuauucugacuaucucugaaauguccaauucuagguucccaguaccaauugauucucugcacaccaguccuacugagaauauuguuguccagugccagaaugggcgcgucacccuugauggugaguugaugggcaccacccaacucuuaccuagccaaaucugugcuuucaggggcguucucaccagaucaacaagcagggccagugaccaggccgauacagcaaccccuagauuauuuaauuauuauuggcauauacaauuggauaaucuaaauggaacuccuuaugauccugcagaagacauaccaggcccccuagggacaccagauuuccggggcaaagucuuuggcguggccagccagagaaauccugauaccacgacuagggcacaugaagcaaagauagacacaacaucuggccguuucaccccaaaacuaggcucacuagagauauccacugaaucugaugauuuugaucaaaacaaaccaacaagauucaccccaguuggcauugggguugaccaugagguagacuuucaacaaugggcucuacccgacuacgcuggucaguucacccacaacaugaacuuagccccagcuguugcucccaacuucccuggugaacagcuccuuuucuuccgcucacaguugccaucuucuggugggcgauccaacgggauuuuagacugccuggucccccaagaauggguacagcacuucuaccaagaaucagcccccucccaaucucaaguggcccugguuagguauaucaacccugacacugguagaguguuauuugaggccaagcugcauaaauuagguuucaugacuauagccaagaauggugacucuccaauaacugucccuccaaauggauacuuuagguuugaaucuugggugaaccccuuuuauacacuugcccccaugggaacugggaaugggcguagaaggauucaauaa

SEQ ID NO: 6322 - RNA, 1623 nt, Artificial Sequence
  capsid_protein__Norovirus__BAG68816
augaagauggcgucgagugacgccaacccaucugauggguccacggccaaccucgucccagaggucaacaaugagguuauggcuuuggagcccguuguuggugccgcuauugcggcaccuguagcgggccaacaaaauguaauugaccccuggauuagaaacaauuuugugcaagccccugguggagaguuuacaguauccccuagaaacgcuccaggugaaauacuauggagcgcgcccuugggcccugauuugaaccccuaccuuucccaucuggccagaauguacaaugguuaugcagguggcuuugaagugcaggugauccucgcggggaacgcguucacugccgggaaaaucauauuugcagcagucccaccaaauuuuccaacugaaggcuugagccccagccaggucacuauguucccccauaugauaguagauguuaggcaacuggaaccugugcugauccccuuaccagauguuaggaauaauuucuaucacuacaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcggguacucaagaauacacaaugaaucuggccucccaaaacuggaacaauuaugacccaacagaagaaaucccagccccucugggaacuccagacuucguggguaagauccaaggcgugcucacccaaaccacaaggggggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguagcaccacccaccaaaaugaaccccaacaauggguacucccaaauuacucagguagagauagucacaaugugcaccuagccccugccguggcccccucuuuuccgggugagcaacuucuuuucuucagguccacuaugcccggaugcagcggguaucccaacaugaauuuggauugccuacucccccaggaguggguacagcacuucuaccaagaggcagccccagcacaaucugauguggcucugcuaagauuugugaauccagacacagguaggguucuguuugaguguaagcuucauaaaucaggcuauguuacaguggcucacacuggccaacaugauuugguuaucccccccaauggcuauuuuagauuugauuccugggucaaucaguucuacacacuugcccccaugggaaauggaacggggcguagacgugcauuauaa

SEQ ID NO: 6323 - RNA, 1626 nt, Artificial Sequence
  capsid_protein__Norovirus__BAH04374
augaggaugagugauggcgcagcgccaaaagccaacggcucugaagccagcggccaggaucuuguuccuaccgccguugaacaggccguccccauucagcccguggcuggcgcggcucuugccgcccccgccgccgggcaaaucaaccaaauugaccccuggaucuuccaaaauuuuguccagugcccccuuggugaguuuuccauuucaccucgaaacaccccaggugagauauuguuugaucuggcccucgggccagggcucaacccuuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccugguuugcaugcuguacacgccacuccgcacaaacagcccgggugaugagucuuuuguggucucuggccgccuucuuucuaagccggcggcugauuuuaauuuuguauaccugaccccccccauugagaggacuaucuaucggauggucgacuugcccguguuacagccgcggcugugcacgcacgcucguuggccggccccgaucuauggccuccugguggacccaucccucccauccaauccacaauggcagaauggaagagugcauguugauggaacccuucuuggcacaacacccgucucuggguccuggguuuccugcuuugcagcugaggccgcuuacgaguuccaguccgggacuggugagguggcaacauucacccugauugagcaggacggguccgcuuacgucccuggugauagggcggcuccccuuggcuaccccgauuucucuggacaacuagagaucgaggugcagacugagacuaccaagaagggugagaagcuaaaggugaccacauuugagaugauccuuggccccacgaccaacguggaccaggugcccuaucaggggaggguguacgcuagccugacggcugcggccucccucgaucugguagauggcagggucagggcaguuccacgcucuguuuaugguuuucaggauguggugccugaguauaaugauggucuuuugguuccccuugcccccccuauuggccccuuccuucccggugaagugcuucugagguuccgaaccuacaugcgucagauugacagcacugacgcugcagcagaggccaucgacugugcccuuccacaggaguucgucucgugguuugcgagcaacgcauucacggugcagucagaggcccugcuccucagauacaggaacacccucacagggcaguugcuguuugagugcaagcucuacagcgaaggcuacauugcccuguccuauucgggcucaggaccacucaccuucccgacugauggcuucuucgaggucgucagcuggguuccccgccuuuaucaauuggccucugugggaagcuuggcgacaggccgaacacucaagcaauaa

SEQ ID NO: 6324 - RNA, 1626 nt, Artificial Sequence
  capsid_protein__Norovirus__BAH04377
augaggaugagugauggcgcagcgccaaaagccaacggcucugaagccagcggccaggaucuuguuccuaccgccguugaacaggccguccccauucagcccguggcuggcgcggcucuugccgcccccgccgccgggcaaaucaaucaaauugaccccuggaucuuccaaaauuuuguccagugcccccuuggugaguuuuccauuucaccucgaaacaccccaggugagauauuguuugaucuggcccucgggccagggcucaacccuuaccucgcccaccucucagccauguacaccggcuggguugggaacauggagguucagcugguccucgccggcaacgccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccugguuugcaugcuguacacgccacuccgcacaaacagcccgggugaugagucuuuuguggucucuggccgccuucuuucuaagccggcggcugauuuuaauuuuguauaccugaccccccccauugagaggacuaucuaucggauggucgacuugcccguguuacagccgcggcugugcacgcacgcucguuggccggccccgaucuauggccuccugguggacccaucccucccauccaauccacaauggcagaauggaagagugcauguugauggaacccuucuuggcacaacacccgucucuggguccuggguuuccugcuuugcagcugaggccgcuuacgaguuccaguccgggauuggugagguggcaacauucacccugauugagcaggacggguccgcuuacgucccuggugauagggcggcuccccuuggcuaccccgauuucucuggacaacuagagaucgaggugcagacugagacuaccaagaagggugagaagcuaaaggugaccacauuugagaugauccuuggccccacgaccaacguggaccaggugcccuaucaggggaggguguacgcuagccugacggcugcggccucccucgaucugguagauggcagggucagggcaguuccacgcucuguuuaugguuuucaggauguggugccugaguauaaugauggucuuuugguuccccuugcccccccuauuggccccuuccuucccggugaagugcuucugagguuccgaaccuacaugcgucagauugacagcacugacgcugcagcagaggccaucgacugugcccuuccacaggaguucgucucgugguuugcgagcaacgcauucacggugcagucagaggcccugcuccucagauacaggaacacccucacagggcaguugcuguuugagugcaagcucuacagcgaaggcuacauugcccuguccuauucgggcucaggaccacucaccuucccgacugauggcuucuucgaggucgucagcuggguuccccgccuuuaucaauuggccucugugggaagcuuggcgacaggccgaacacucaagcaauaa

SEQ ID NO: 6325 - RNA, 1623 nt, Artificial Sequence; identical to SEQ ID NO: 5585
  capsid_protein__Norovirus__BAH29786

SEQ ID NO: 6326 - RNA, 1623 nt, Artificial Sequence
  capsid_protein__Norovirus__BAH30707
augaagauggcgucgaaugacgccaccccaucugauggguccacagccaaccuugucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuuaggcccugauuugaaucccuaccucucccauuuggccagaauguauaaugguuaugcaggugguuucgaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauucccuuacccgauguuaggaauaauuucuaccacuacaaucaaucaaaugaccccaccaucaaauugauagcaauguuguacacaccacuuagggcuaauaaugcuggggacgaugucuucacaguuucuugucggguucucacgagaccauccccugauuuugauuuuauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugauggcgugcuccuagguacuacccaacugucuccugucaauaucugcaccuucagaggggaugucacccauauuucagguagucguaacuacacaaugaauuuggcgacucaaaauuggaacaguuaugacccaacagaagaaaucccagccccucuaggaacuccagauuuuguggggaagauccaaggugugcucacccaaaccacaagggcagauggcucgacccgcggccacaaggcuacaguguacacugggagcgccgauuuugcuccaaaacuggguagaguucaauuugccacugacacagacaaugauuuugaugcuaaccaaaacacaaaguucaccccagucggugucauccaggaugguaacacugcccaccgaaaugaaccccaacaaugggugcucccaaguuacucaggcagaaauagucacaaugugcaccuggcccccgcuguagcccccacuuuuccgggugagcaacuucucuucuucagaucuacuaugcccggauguagcggguaccccaacauggauuuggacugucugcucccccaggaaugggugcaguauuucuaucaagaggcagccccagcacaaucugauguggcucugcuaagauuugugaauccagacacaggcaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaaugggacggggcguagacgugcauuauaa

SEQ ID NO: 6327 - RNA, 1653 nt, Artificial Sequence
  capsid_protein__Norovirus__BAL40869
augaagauggcgucgaaugacgccgcuccaucaaaugauggugcugccaaccucguaccagaggccaauaaugagguuauggcacuugaaccgguggugggagccucaaucgcagcuccuguugucggucagcaaaauauaauugaccccuggauuagagaaaauuuuguccaagcaccacagggcgaguucacuguuucaccaaggaauucgcccggugaaaugcuucuaaaucuugaauugggcccagaacuuaacccuuacuugagucauuugucccgcauguacaauggguaugcugguggcaugcagguucaggugguccuagcugggaaugcguucacagcugggaagaucaucuuugccgccgugccaccacacuucccuguggauaacauuagugcagcccagauaacuaugugcccccaugugauuguugaugugagacagcuugaaccagugcuucugccccuccccgauauaaggaauagguucuuccauuacaaccaggaaaacaccccucggaugagacucguggccaugcucuacacgccucuaagggcuaauucuggugaggacguguucacuguguccuguaggguucugacucgccccgcuccagauuuugaguucacauuuuuaguuccaccaacuguugaaucaaaaacaaagcccuucacucuaccuauccuaacucuuggugaguugucuaacucccguuuuccggcugccauagauaugcuuuauacugaucccaaugagucaauaguuguucagccccaaaaugguagguguacucuugauggcacauugcaaggcacaacacaauuggucccaacgcagauuugugccuuuagaggcacccugaucagccagacugcgagagcggucgauucaacagacuccccccagagagcccgugaucacccguuacacguccaggucaagaaccuagauggcacacaguaugacccaacagaugauauuccugcaguccugggggcuauugauuucaaagguacaguguucggaguggcuagucagagggaugucucuggaacacaagaacagggccauuaugccacccgagcccaugaagcacacauugauacaacugacccaaaguaugcacccaaauuaggcacaauucuuaucaaaucugaaucuccugauuucaacacaaaccaacccauuagguucacuccagugggcaugggugacaauaauuggagacagugggaguugccugauuauucugguagauugacuuuaaauaugaaccuugcccccgcuguuuccccaucuuucccuggugaacgaauccuuuucuuuaggucuauaguaccaucagcuggaggcuacgggucuggcuauauagacugucucauaccccaggagugggugcaacacuucuaccaggaggcagcaccuucacaaucugcuguggcacuggucagguaugucaaccccgacacugggcguaacaucuuugaggccaaguugcacagagaaggguuccucaccguggccaauucuggaaacaauccuauuguaguucccccuaaugguuauuuuagauuugaggcuuggguuaaccaauuuuauacacuugcccccaugggaucuggacaggggcguagaagggcucaguaa

SEQ ID NO: 6328 - RNA, 1644 nt, Artificial Sequence
  capsid_protein__Norovirus__BAL40870
augaagauggcgucgagugacgcugcuccaucgaaugauggcgcugccaaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucacugucucaccgaggaacucgccuggugagaugcuauuaaaucuugaauugggcccagaacucaacccuuaccuaagucaccugucccgcauguauaauggguaugcugguggcaugcagguucaggugguccuagcugggaaugcguucacagcugggaaaaucaucuuugccgccguaccaccacauuuucccguagaaaacaucagugcagcucagauaacuaugugcccccauguaauuguugaugugagacaacuugaaccaguacuucugccccuuccugacauaaggaacagguucuuucauuacaaucaggagaacaccccccggaugagacuuguggcuaugcuuuacaccccccucagggccaacucuggugaagauguguuuacuguuucuuguaggguauugacccguccugccccugauuuugaauuuacuuucuugguaccaccaacuguugaaucaaagacuaagccuuucacacugcccauauuaacucuuggugagcuaucuaacuccagauucccagccccaauagauauguuguacacugacccaaaugagggaaucgugguccaaccacaaaaugguaggugcacucuugauggcacucugcaaggcaccacacaacugguccccacccaaauuugugcuuucaggggcacacuaauuggccaaacaucaagaucuucagacucaaccgacucagccccucggagaagggaucacccacuccaugugcaauuaaagaaccuugauggcacgcaguacgacccaacugaugaagugccagcaguccuuggugccauugacuucaaggggacugucuuugggguggccagucagagagaugugucagggcaacaagugggagcaacucgagcucaugaagugcacaucaacacaaccgauccuagguauacaccaaaacugggauccauucucaugcacucagagucggacgacuuugugacuggacagccgguccgcuucacacccauaggaaugggugacaacgacuggcaccagugggagcugccugacuacucuggacaccuaacccugaacaugaaccuugccccagcagucgcuccugcuuuuccgggcgagaggauucuuuucuucaggucaauagucccgucugcugguggcuaugggucuggacaaauagauugccucauaccacaggaguggguucagcauuucuaccaggaagcugcaccaucccaaucugccguggcacucauuagguaugucaauccugacacaggcagaaacaucuuugaggcuaaauugcacagggaagguuucaucaccguggcaaauucugguaacaaccccauuguugcccccccuaauggguauuuuagguuugaggcuugggugaaucaauuuuacacuuugacccccaugggaacuggucaggggcguaggaggaaucaauaa

SEQ ID NO: 6329 - RNA, 1644 nt, Artificial Sequence
  capsid_protein__Norovirus__BAL40871
augaagauggcgucgaaugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguucaagcaccacagggcgaguucaccgucucaccgaggaacucgccuggugagaugcuauuaaaucuugaauugggcccagaacucaacccuuaccuaagucaccugucccguauguauaauggguaugcugguggcaugcagguucaggugguccuagcugggaaugcguucacagcugggaaaaucaucuuugccgccguaccaccacauuuucccguggaaaacauuagugcagcucaaauaacuaugugcccccauguaauuguugaugugagacaacuugaaccaguacuucugccccuuccugacauaaggaauagguucuuucauuacaaucaggagaacaccccccggaugagacuuguggcuaugcuuuacaccccccugagggccaacucuggugaugauguguuuacugucucuuguagggucuugacccguccugccccugauuuugaauuuacuuucuugguaccaccaacugucgaaucaaagacuaaaccuuucacacugcccauauuaacucuuggugagcuaucuaacuccagauucccagccccaauagauauguuguacacugacccaaaugagggaauugugguccaaccacaaaaugguaggugcacucuugauggcacucugcaaggcaccacacaacugguccccacccaaauuugugcuuucaggggcacacuaauuggccaaacaucaagaucuucagacucaaccgacucagccccucggagaagggaucacccacuccaugugcaauuaaagaaccuugauggcacgcaguacgacccaacugaugaagugccagcaguccuuggugccauugacuucaaggggacugucuuugggguggccagucagagagacgugucagggcaacaagugggagcaacucgagcccaugaagugcacaucaacacaaccgauccuagguauacaccaaaacugggauccauucucaugcacucagagucggacgacuuugugacuggacagccgguccgcuucacacccauaggaaugggugacaacgacuggcaccagugggagcugccugacuacucuggacaccuaacccugaacaugaaccucgccccagcagucgcuccugcuuuuccgggcgagaggauucuuuucuucaggucaaugguuccgucugcugguggcuaugggucuggacaaauagauugccucauaccacaggaguggguucagcauuucuaccaggaagcugcaccaucccaaucugccguggcacucauuagguaugucaauccagacacaggcagaaacaucuuugaggcuaaauugcacagggaagguuucaucaccguggcaaauucugguaacaaccccauuguuguccccccuaauggguauuuuagguuugaggcuugggugaaucaauuuuacacuuugacccccaugggaacuggucaggggcguaggaggaaucaguaa

SEQ ID NO: 6330 - RNA, 1644 nt, Artificial Sequence
  capsid_protein__Norovirus__BAL40872
augaagauggcgucgaaugacgcugcuccaucgaaugauggugcugccaaccucguaccagaggccaacaaugagguuauggcacuugaaccgguggugggagccucaauugcagcuccugucgucggucaacaaaauauaauugaccccuggauuagagaaaauuuuguucaggcaccacagggugaguuuacuguuucaccaagaaacucgccuggugagaugcuuuuaaaucuugaauuaggcccagagcucaauccuuaccugagucauuuaucccgcauguacaaugguuaugcugguggcaugcagguucaggugguccuagcugggaaugcguucacagcugguaaaaucaucuuugccgccguuccaccacauuuuccuguagagaauauuagugcagcucaaauuacaaugugcccccaugugauuguugaugugagacagcuugaaccuguacuuuugccccucccugacauaaggaauagauucuuucacuauaaccaggaagacaccccccggaugagacuuguagccauguuguacacaccucuuagagcaaacucuggugaggacguguucacagugucuugcagagucuugacccgcccagccccugacuuugaguuuacguucuuagugccaccaaccguggaaucaaagaccaagccuuucacacucccuauuuuaacccuaggggaacuauccaacuccagauucccugcuccaauagauauguuguacacagaucccaaugaaacaauugugguacaaccacaaaauggcagaugcacccuagaugggacacuccaagggaccacccagcuggugcccacccaaauuugcucuuucaggggcacguuaaucagccaaacgucgaggucagcagauucaacggacucagccccacgggugaggaaccauccccuucacguucagcugaagaaccucgacgggacaccauaugacccaacagaugaggugccagcaguucugggugccauagacuucaaaggaacuguguuuggagucgcuagccagagaaacaccacagggaacucuguaggggcgacccgugcccaugagguacacauagacaccacaaacccuagauacaccccaaaacuugguucuguguugaugaauucugagucuagugauuuugaugauggacaaccaacuugcuucacucccauuggcaugggagcagaugauuggcaccaaugggaauugcccgaauauucuggucaccuuacucuuaacaugaaccuagcccccgcaguugcuccugcuuuccccggugagcgcauccucuucuuuaggucagugguuccaucugcuggugguuacggaucaggccaaauagacugccucaucccacaggaguggguucagcacuucuaccaggaggccgccccaucacaaucugcgguggcucuuauuagauauguuaacccugacacugggagaaacaucuuugaggcaaagcuacauagagaaggguucauuacuguggcaaauucuggaaauaaccccauaguugugcccccaaauggcuauuucagguuugaggccugggucaaucaauuuuacacacucacccccaugggaacuggacaggggcgcaggagaguccaauaa

SEQ ID NO: 6331 - RNA, 1644 nt, Artificial Sequence
  capsid_protein__Norovirus__BAL40873
augaagauggcgucgaaugacgccgcuccaucgaaugauggugcugccaaccucguaccagaggccaacaaugagguuauggcacuugaaccgguggcgggagccucaauugcagcuccugucgucggucaacaaaauauaauugaccccuggauuagagaaaauuuuguucaggcaccacagggugaguuuacuguuucaccaagaaacucgccuggugagaugcuuuuaaaucuugaauuaggcccagagcucaauccuuaccugagucauuuaucccgcauguacaaugguuaugcugguggcaugcagguucaggugguccuagcugggaaugcguucacagcugguaaaaucaucuuugccgccguuccaccacauuucccuguagagaacauuagugcagcucaaaucacaaugugcccccacgugauuguugauguaagacagcuugaaccuguacucuugccccucccugacauaaggaauagauucuuucacuacaaccaggaagacaccccucggaugagacuuguggccauguuguacacaccucuuagagcaaacucuggugaggacguguucacagugucuugcagggucuugacccgcccagccccugacuuugaguucacguucuuagugccaccaaccguagaaucaaagaccaagccuuuuacacucccuauuuugacccuaggggaacuauccaauuccagauucccugcuccaauagacaugcuuuacacagaucccaaugagacaaucgugguacaaccacaaaauggcaggugcacccuagaugggacucuccaagggaccacccagcuggugcccacccaaauuugcucuuuuaggggcacguugaucagucaaacgucgaggucugcagauucaacagauucagcuccacgggugaggaaccauccccuucacguucagcugaagaaccucgacgggacaccauaugacccaacagaugagguaccggcaguucugggugccauagauuucaaaggaacuguguuuggagucgcuagccagagaaacaccacagggaacucuguaggggcgacccgugcccacgaggugcacauagacacuacaaacccuagauacaccccaaaacuugguucuguguugaugcauucugagucuagugauuuugaugauggacaaccgauuagcuucacccccauuggcaugggagcagaugauuggcaccaaugggaauugcccgaauauucuggucaccucacucucaauaugaaccuagcccccgcaguugccccugcuuuccccggugagcgcauccucuucuucaggucaguuguuccaucugcuggugguuacgggucgggacaaauagauugccucaucccacaggaauggguucagcacuucuaucaggaggccgccccaucacaaucugcgguggcucuuguuagauauguuaacccugacacugggagaaacaucuuugaggcaaagcuacauagagaaggguuccucacuguggcaaauucuggaaacaaccccauaguugugcccccaaaugguuauuucagguuugaggccugggucaaucaauuuuauacacucacccccaugggaacuggacaggggcguaggagaguccaauaa

SEQ ID NO: 6332 - RNA, 1626 nt, Artificial Sequence
  capsid_protein__Norovirus__BAL60900
augaggaugagugauggcgcagcgccaaaagccaacggcucugaagccagcggccaggaucuuguucuuaccgccguugaacaggccguccccauucagcccguggcuggcgcggcucuugccgcccccgccgccgggcaaaucaaccaaauugaccccuggaucuuccaaaauuuuguccaaugcccccuuggugaguuuuccauuucaccucgaaacaccccaggugaaauacuguuugaucuggcccucggaccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccuggucugcaugcuguacacgccacuccgcacaaacagcccgggugaugagucuuuuguggucucuggccgccuucuuucuaagccggcagcugauuucaacuuuguauacuugaccccccccaucgagaggaccaucuaccggauggucgacuugcccguguuacagccgcggcugugcacgcacgcacguuggccugcuccggucuauggccucuugguagacccaucccuccccuccaauccccaguggcagaauggaagagugcauguugauggaacccuccuuggcacaacgcccgucucugggucuuggguuuccugcuucgcagcugaggccgccuacgaguuccaguccgggacuggugagguggcaaccuucacucugauugagcaggacggguccgccuacgucccuggcgagagggcggcuccccuuggcuaccccgacuucuccgggcaacuggagaucgaggugcagacugagaccaccaagagaggugagaagcugaaggugaccaccuuugagaugauucuuggccccaccaccaacguggaccaagcgcccuaccagggcaggguguacgcuagccuaucggcugcggccucccucgaccugguggaugguagaguuagggcagucccacgcucuaucuauggcuuccaggaugugauaccugaguacaaugauggucuucugguuccccuugcccccccaauuggucccuuccuucccggugaagugcuccugagguuccgaaccuacaugcgucagguugacagcucugacgccgcagcggaggccauugacugcgcccuuccacaagaguucgucucgugguuugcgaguaacggauucacggugcagucagaggcccugcuccuuagguacaggaacacccucacagggcaauugcuguuugagugcaagcucuacagcgaaggcuacaucgcccuguccuauucgggcucaggaccacucaccuucccgacugauggcuucuucgagguugucagcugggucccccgccucuaucaauuggccucugugggaagcuugguaacaggccgaacgcucaaacaauaa

SEQ ID NO: 6333 - RNA, 1623 nt, Artificial Sequence
  capsid_protein__Norovirus__BAQ55211
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucccaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaggcacuaguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguggugcccacagaaaugaaccccaacaauggguacucccaaauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6334 - RNA, 1623 nt, Artificial Sequence
  capsid_protein__Norovirus__BAQ55212
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaagcacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6335 - RNA, 1620 nt, Artificial Sequence
  capsid_protein__Norovirus__BAQ55213
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuucaggcacuaguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgacacugauacaaacaaugaucuugaaacuggccaaaacacaagguucaccccagucggugucauccaggaugguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6336 - RNA, 1623 nt, Artificial Sequence
  capsid_protein__Norovirus__BAQ55214
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuucaggcacuaguacuuacagaaugaauuuggcuucucaaaauuggaacaauuaugacccaacagaagaaaucccagccccucugggaacuccagauuucgugggaaagauccaaggcaugcucacccagaccacaaagggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguggugcccacagaaaugaaccccaacaauggguacucccagauuacucagguaaaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6337 - RNA, 1620 nt, Artificial Sequence
  capsid_protein__Norovirus__BAQ55215
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaggcacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgacacugauacaaacaaugaucuugaaacuggccaaaacacaagguucaccccagucggugucauccaggaugguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6338 - RNA, 1620 nt, Artificial Sequence
  capsid_protein__Norovirus__BAQ55216
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccagaucacuauguucccccacauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaggcacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgacacugauacaaacaaugaucuugaaacuggccaaaacacaagguucaccccagucggugucauccaggaugguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6339 - RNA, 1620 nt, Artificial Sequence
  capsid_protein__Norovirus__BAQ55217
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuucaggcacucauacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgccacugauacaaacaaugauuuugaaacuggccaaaacacaagguucaccccagucggugucauccaggaugguagugcccacagaaaugaaccccaacaauggguacucccagauuacucagguaaaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6340 - RNA, 1623 nt, Artificial Sequence
  capsid_protein__Norovirus__BAQ55218
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaaacacucauacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucaccacugauacagacaaugauuuugaaacuggccaaaacacaagguucaccccagucggugucauccaggaugguaauggugcccacagaaaugaaccccaacaauggguacucccagauuacucagguggaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6341 - RNA, 1623 nt, Artificial Sequence
  capsid_protein__Norovirus__BAR47396
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugacuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaauuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuacucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 6342 - RNA, 1623 nt, Artificial Sequence
  capsid_protein__Norovirus__BAR47397
augaagauggcgucgaaugacgccaacccaucugauggguccgcagccaaccucgucccagaggucaacaaugagguuauggcuuuggagcccguugucggugccgcuauugcagcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccaucccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaauaauuaugacccaacagaagaaauuccagccccccuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaaugcccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcgcaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6343 - RNA, 1623 nt, Artificial Sequence
  capsid_protein__Norovirus__BAR47398
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggucccgaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggcgccuuuguuguucaaccgcaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaacuaugacccaacagaagaaauuccagccccucuaggaaccccagauuucgugggaaagauccaaggugugcucacucaaaccacaaaggcagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaucaagaggcagcuccagcacaaucugauguggcucuauugagauuugugaauccagaccaggggaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 6344 - RNA, 1623 nt, Artificial Sequence
  capsid_protein__Norovirus__BAR47400
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacuaauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucagaccacgaagggagauggcucgacccguggucauaaagcuacaguuuacacugggagugcccccuucacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6345 - RNA, 1623 nt, Artificial Sequence
  capsid_protein__Norovirus__BAR47401
augaagauggcgucgaaugacgccaacccaucugauggguccgcagccaaccucgucccagaggucaacaaugagguuauggcucuggagcccguugucggugccgcuauugcggcaccuguagcgggccaacaaaauguaauugaccccuggauuagaaauaauuuuguacaagccccugguggagaguucacaguaucuccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaaccuguguugauccccuuaccugauguuaggaauaacuucuaucacuauaaucagucaaaugauucuacuauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaccuuaacuguugaagaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggacgucacccacauugcaggcucucgugauuacacaaugaauuuggcuucucuaaauuggaacaauuacgacccaacagaagaaauuccagccccucuaggaacuccagauuucgugggaaagauucaaggugugcucacucaaaccacaaagggggauggcucgacccguggccauaaagcuacaguuuacacugggagugcccccuuuacuccaaagcugggcaguguucgauucaguacugacacagaaaaugauuuugaaacucaccaaaacacaaaauucaccccagucggugucauccaggacgguaguaccacccaccgaaaugaaccccaacaaugggugcucccaaguuauucagguagagauguccauaauguacaccuagccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6346 - RNA, 1623 nt, Artificial Sequence
  capsid_protein__Norovirus__BAR47403
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaauuuacacugggagugcccccuuuacaccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguagcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6347 - RNA, 1623 nt, Artificial Sequence
  capsid_protein__Norovirus__BAR47404
augaagauggcgucgaaugacgccaacccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugaucccccuaccugauguuaggaauaacuucuaucacuauaaccagucaaaugauucuaccauuaaauugauagcaaugcuguauacaccacuuagggcuaauaaugcuggggaagaugucuuuacagucucuugucgaguucucacgaggccauccccugauuuugauuuuauauucuuagugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacauuugcaccuucagaggggaugucacccacauugcagguucucguaauuacacaaugaauuuggccucucuaaauuggaacaauuaugacccaacagaagaaaucccagccccucuagggacuccagacuucgugggaaagauucaaggugugcucacucaaaccacaaagggagauggcucgacccguggccauaaagcuacaguuuacacugggagugcccccuuuacuccaaagcuggguaguguucaauucaguacugauacagagaaugauuuugaaacucaccaaaauacaaaauucaccccagucggugucauccaggaugguggcaccacccaccgaaaugaaccccaacaaugggugcucccaaguuauucagguaggaaugucccuaauguacaccuagccccugcuguagcccccacuuuuccgggugaacaacuucucuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugacuccuggguuaaucaauucuacacgcuugcccccaugggaaauggaacggggcguagacgugcuuuauaa

SEQ ID NO: 6348 - RNA, 1623 nt, Artificial Sequence
  capsid_protein__Norovirus__BAR47405
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggaguacccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 6349 - RNA, 1623 nt, Artificial Sequence
  capsid_protein__Norovirus__BAR47406
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccauauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaagaugucuuuacagucucuugucgaguccucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucgguacugauacagaaaaugauuuugaaacucaccagaacacaaaauucaccccagucggugucauccaggaugguggcaccacccaccgaaaugaaccccaacaaugggugcucccaaguuauucagguagaaaugucccuaauguacaccuagcccccgcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuugugaauccagacacggguaggguucuuuuugagugcaaacuucacaaaucaggcuaugucacaguggcucacaccggccagcaugauuuggucaucccccccaauggcuauuuuagguuugauuccuggguuaaucaguucuacacacuugcccccaugggaaauggaacggggcguagacgugcuuuauaa

SEQ ID NO: 6350 - RNA, 1623 nt, Artificial Sequence
  capsid_protein__Norovirus__BAR47407
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauauuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccauuauaaucagucaaaugacucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucugguaauuacacaaugaauuuggcuucuguaaauuggaacaauuaugacccaacagaagaaauuccagccccucuaggaacuccagauuuugugggaaagauccaggguaugcucacccaaacuacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguaacaccacccaccgaaaugaaccccaacaaugggugcucccaaguuauucagguagaaaugucccuaauguacaccuagccccugcuguagcccccacuuucccaggugaacaacuucucuucuuuagguccacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguagcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 6351 - RNA, 1623 nt, Artificial Sequence
  capsid_protein__Norovirus__BAR47408
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuaaaaauaauuuuguacaagccccugguggagaguucacaguauccccuagaaacgcaccaggcgagauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaauuucuaccauuauaaucagucaaaugauucuaccauuaaauugauagcaauguuguauacaccacuuagagcuaauaaugcuggggaagaugucuucacagucucuugucgaguccucacgaggccaucccccgauuuugauuuuauauuuuuggugccaccuacaguugagucaagaacuaaaccauuuacugucccgaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaaccccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuccauaaaucagguuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 6352 - RNA, 1623 nt, Artificial Sequence
  capsid_protein__Norovirus__BAR47410
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaaugcuccaggugaaauacuauggagcgcgcccuugggcccugaucugaaucccuaccuaucucauuuggccagaauguauaaugguuaugcaggugguuuugaagugcaggugauucucgcggggaacgcguucaccgccgggaaaaucauauuugcagcagucccaccaaauuuuccaacugaaggcuugagucccagucaggucaccauguucccccauauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagaaaugaccaacucaagguuccccaucccuuuggagaaguuguucacgggucccagcagugccuuuguuguucaaccacaaaauggcagaugcacaacugauggcgugcucuuaggcacuacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccaguuggugucauccaggaugguggcaccacccaccgaaaugaaccucaacagugggugcucccaaguuauucagguagaaaugucccuaauguacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcucuauugagauucgugaauccagacacggguaggguccuguuugagugcaaacuucauaaaucagguuaugucacaguggcccacaccggccagcaugauuuggucaucccccccaaugguuauuuuagguuugauuccuggguuaaccaauucuacacgcuugcccccaugggaaacggaacggggcguagacgugcuuuguaa

SEQ ID NO: 6353 - RNA, 1623 nt, Artificial Sequence
  capsid_protein__Norovirus__BAR47412
augaagauggcgucgagugacgccaacccaucugauggguccgcggccaaccucgucccagaggucaacaaugagguuauggcucuggagcccguuguuggugccgccaucgcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaacgcuggggaugaugucuucacaguuucuugccgaguucucacgagaccaucccccgauuuugauuucauauuucuagugccacccacaguugagucaagaacuaaaccauucucugucccaguuuuaacuguugaagagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaauucaauuugaaacugacacagaccaugauuuugaagcuaaccaaaacacaaaguucaccccagucggugucauccaagaugguggcaccacccaccgaaaugaaccccaacagugggugcucccaagcuacucaggcagaaauacccauaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaucaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguagcauaa

SEQ ID NO: 6354 - RNA, 1623 nt, Artificial Sequence
  capsid_protein__Norovirus__BAR47413
augaagauggcgucgagugacgccaacccaucugauggguccgcggccaaccucgucccagaggucaacaaugagguuauggcucuggagcccguuguuggugccgcuaucgcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaacgcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaauucaauuugaaacugacacagaccaugauuuugaagcuaaccaaaacacaaaguucaccccagucggugucauccaagaugguggcaccacccaccgaaaugaaccccaacaguggaugcucccaagcuacucaggcagaaauacccauaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaucaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguagcauaa

SEQ ID NO: 6355 - RNA, 1623 nt, Artificial Sequence; identical to SEQ ID NO: 6354
  capsid_protein__Norovirus__BAR47414

SEQ ID NO: 6356 - RNA, 1623 nt, Artificial Sequence; identical to SEQ ID NO: 6354
  capsid_protein__Norovirus__BAR47415

SEQ ID NO: 6357 - RNA, 1623 nt, Artificial Sequence
  capsid_protein__Norovirus__BAR47417
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggccccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagacgguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacgugcaguauaa

SEQ ID NO: 6358 - RNA, 1623 nt, Artificial Sequence
  capsid_protein__Norovirus__BAR47418
augaagauggcgucgagugacgccaacccaccugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcaguuccaccaaauuuuccaacugaaggcuugagccccagccaggucacuauguucccccauauaguaguggauguuaggcaacuagaaccuguguugauucccuuacccgauguuaggaauaacuucuaucauuacaaucaaucaaaugacccuaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggggaugucacccauaucacagguagucauaacuacacaaugaauuuggcuucucaaaauuggaacaauuaugacccaacagaagaaaucccagccccucuaggaacuccagauuuuguggggaaaauucaaggcgugcucacccaaaccacaaggacagauggcucaacacgcggccacaaagcuacaguguacacugggagcgccgacuuugcuccaaaacuggguagaguucaauuugaaacugacacaaaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 6359 - RNA, 1623 nt, Artificial Sequence
  capsid_protein__Norovirus__BAR47421
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaucuaucccauuuggccagaauguacaaugguuaugcaggugguuuugaagugcagguaauucucgcggggaacgcguucaccgcugggaaggucauauuugcagcagucccaccaaauuuuccaacugaaggcuugagccccagccaggucacuauguucccccauauagugguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcguacuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugcucccucaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 6360 - RNA, 1623 nt, Artificial Sequence
  capsid_protein__Norovirus__BAR47422
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6361 - RNA, 1623 nt, Artificial Sequence
  capsid_protein__Norovirus__BAR47423
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgacguuaggaauaauuucuaucauuacaaucaaucaaaugaucccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacggguagucguaacuacacaaugaauuuggcuucucaaaauuggaacaauuaugacccaacagaagaaaucccagccccuuuaggaacuccagauuuuguggggaagauucaaggcgugcucacccaaaccacaaggacagauggcucaacacguggccacaaagcuacaguguacacugggagcgccgauuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuaugcuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6362 - RNA, 1623 nt, Artificial Sequence
  capsid_protein__Norovirus__BAR47424
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcagaugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggaucaacacgcggccacaaagcuacaguguacacugggagcgccgacuuugcuccaaaacuggguagaguucaauuugaaacugauacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuccucuucuucagauccaccaugcccggaugcagcggguaccccaacauggauuuggacugucugcucccccaggaaugggugcaguacuucuaccaagaggcagccccagcacagucugauguggcucugcugagauuugugaauccagacacagguaggguuuuguuugaguguaagcuucauaaaucaggcuauguuacaguggcucacacuggccaacaugauuugguuaucccccccaaugguuauuucagguuugauuccugggucaaccaguuuuacacgcuugcccccaugggaaauggaacggggcguagacgugcaguauaa

SEQ ID NO: 6363 - RNA, 1623 nt, Artificial Sequence
  capsid_protein__Norovirus__BAR47426
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuaguaccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagacggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccucccaaugguuauuuuagguuugauuccugggucaaccaguuuuacacgcuugcccccaugggaaauggaacggggcguagacgugcacuauaa

SEQ ID NO: 6364 - RNA, 1623 nt, Artificial Sequence
  capsid_protein__Norovirus__BAS53731
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuucccaacugaaggcuugagucccagccaggucacuauguucccccacauaauaguggauguuaggcaauuggaaccuguguugaucccccuaccugauguuaggaauaacuucuaucacuauaaucagucaaacgauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccggucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 6365 - RNA, 1623 nt, Artificial Sequence
  capsid_protein__Norovirus__BAS53732
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggggaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaagguuugagucccagccagguuacuauguucccccacauaauaguagauguuaggcaauuggaaccuguguugaucccuuuaccugauguuaggaauaacuucuaccacuauaaucagucaaaugauucuaccauuaaauugauagcaaugcuguacacaccacuuagggccaauaaugcuggggaugaugucuucacagucucuugucgaguccucacgagaccauccccugauuuugauuuuauauuucuggugccacccacaguugagucaagagccaagccauucacugucccaaucuuaacuguugaagaaaugaccaauucaagauuccccauuccuuuggaaaaacuguucacgggucccagcagugccuuuguuguucaaccacaaaauggcagaugcacuacugauggcgugcucuuaggcaccacccaacugucuccugucaacaucugcaccuucagaggagaugucacccacauugcggguucccgcaauuacacaaugaauuuggccucucuaaauuggaacaauuacgacccaacagaagaaauuccagccccccugggaacuccagauuuugugggaaagauccaaggugugcucacucaaaccacaaagggagacggcucgacccggggccauaaagcuacaguuuacacugggagugccgacuuuacuccaaagcugggcaguguccaauuugguacugacacagaaaaugacuuugaaacucaccaaaacacaaaauucaccccaguaggugucauccaggaugguggcaccacccaccgaaaugaaccccaacaaugggugcucccaaguuauucagguagaaauguccauaauguacaccuagccccugcuguagcucccaauuuuccgggugaacaacuucuuuucuucagguccacuaugcccggauguagcggguaucccaacauggauuuggauugccugcucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccaacaugauuuggucaucccccccaauggcuauuuuagguuugauuccuggguuaaccaauucuacacacuugcccccaugggaaauggaacggggcguagacgugcuuuauaa

SEQ ID NO: 6366 - RNA, 1623 nt, Artificial Sequence
  capsid_protein__Norovirus__BAS53733
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaccugaaucccuaccuaucucauuuggccagaauguauaaugguuaugcaggugguuuugaggugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaugaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaguuggaacaauuaugacccaacagaagaaauuccagccccucuaggaaccccagauuuugugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacgugcuuuauaa

SEQ ID NO: 6367 - RNA, 1623 nt, Artificial Sequence
  capsid_protein__Norovirus__BAS53734
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaagguuugagucccagccagguuacuauguucccccacauaauaguagauguuaggcaauuggaaccuguguugaucccuuuaccugauguuaggaauaacuucuaccacuauaaucagucaaaugauucuaccauuaaauugauagcaaugcuguacacaccacuuagggccaauaaugcuggggaugaugucuucacagucucuugucgaguccucacgagaccauccccugauuuugauuuuauauuucuggugccacccacaguugagucaagaaccaagccauuuacugucccaaucuuaacuguugaagaaaugaccaauucaagauuccccauuccuuuggaaaaacuguucacgggucccagcagugccuuuguuguucaaccacaaaauggcagaugcacuacugauggcgugcucuuaggcaccacccaacugucuccugucaacaucugcaccuucagaggagaugucacccacauugcggguucccgcaauuacacaaugaauuuggccucucuaaauuggaacaauuacgacccaacagaagaaauuccagccccccugggaacuccagauuuugugggaaagauccaaggugugcucacucaaaccacaaagggagacggcucgacccggggccauaaagcuacaguuuacacugggagugccgacuuuacuccaaagcugggcaguguccaauuugguacugauacagaaaaugacuuugaaacucaccaaaacacaaaauucaccccaguaggugucauccaggaugguagcaccacccaccgaaaugaaccccaacaaugggugcucccaaguuauucagguagaaauguccauaauguacaccuagccccugcuguagcucccaauuuuccgggugaacaauuucuuuucuucagguccacuaugcccggauguagcggguaucccaacauggauuuggauugccugcucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccaacaugauuuggucaucccccccaauggcuauuuuagguuugauuccuggguuaaccaauucuacacacuugcccccaugggaaauggaacggggcguagacgugcuuuauga

SEQ ID NO: 6368 - RNA, 1623 nt, Artificial Sequence
  capsid_protein__Norovirus__BAS53945
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaucugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgacgccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaacuacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguaacaccacccaccgaaaugaaccccaacaaugggugcucccaaguuauucagguagaaaugucccuaaugugcaccuagccccugcuguagcccccacuuucccgggugaacaacuucuuuucuuuagguccacuaugcccggaugcagcggguaucccaacauggauuuggauugccuacucccucaggagugggugcagcacuucuaccaagaggcagccccagcacaaucugauguggcucuauugagguuugugaacccagacacggguaggguccuauuugaguguaaacuucauaaaucagguuaugucacaguagcucacaccggccagcaugauuuggucaucccccccaaugguuauuuuagguuugauuccuggguuaaucaauucuacacacuugcccccaugggaaauggaacggggcguagacgugccuuauaa

SEQ ID NO: 6369 - RNA, 1632 nt, Artificial Sequence
  capsid_protein__Norovirus__CAK22261
augaugauggcgucuaaggacgcuucaccaagcgcagauggcgcaaauggcgccggucagcuugugccggagguuaauaaugcugaaccacugccacuugauccgguggcgggagcuuccaccgcucuugccacugcugggcaaguuaauaugauugauccauggauuuucaacaacuuuguccaggccccucagggugaauucacuauauccccaaauaacacccccggcgauauucuguuugauuugcaauuaggcccacaccuaaauccuuuccuagcacauuugucccagauguauaauggcuggguuggcaacaugcgagucagggucauccuggcuggcaaugccuuuacugcugguaaaguuauaguauguugugucccuccugguuuucaaucuaggacccuuucuauagcucaggccacgcucuuuccccacaucauagcugaugugcgaacuuuagaaccaauugagaucccccuagaggauguuaggaauacacuuuaccauaccaaugauaaucaaccaacaaugcgucuguugugcaugcuuuacacgccacugcgcaccggugguggcucuggcgguacagaugcauuuguuguggcaggccgaguucuaacuugcccuagcucugauuuuaauuucuuguuccuggucccaccuacuguggagcagaagacccgccccuuuagugugcccaauauacccuugcaguugcuuuccaauucccguguucccaaucuuauacaaagcaugguucuuucgccugaccaggcccagaauguucaauuccagaauggccgcugcacuacugaugggcagcuuuuaggcacaacaccuguuucuguuagucagauauuaaaguuuagaggaaaggugucagcuggcucuagagucauuaaucuuacugaacuggaugguucccccuucuuggcuuuugaggccccagcacccacagguuucccugacuugggaaccagugacuggcauguugaaaugagccuuaauucaaauagucaaaguucuggcaacccaauuuuauugagggacauacagccaaauucuucugauuuugugccacacuugggcaguguggcugucaccacugcaauugauguggcuggggauuacacugguacaauccaguggacuucccaaccauccaaugucaccccagucccugaugucaacuucuggaccaucccccaguacgggucaaauuuagcagaagcuucccagcuugccccuguaguguaccccccaggauuuggugaggcuauaguguacuuuaugucccccauaccaggcccuaacacagcacacaaacccaauuugguacccugccuacucccacaagaauuugugacucauuuugucagugaacaggccccauccaugggugaggcagcccucguccacuauguagacccagacaccaaccgcaacuugggcgaguucaaacuguauccugaagguuucaucacuugugugccaaaugguacugguccacaacaacuuccucuuaauggagucuuugucuuugccucuuggguguccagauucuaucaauuaaagccugugggaacggccagcucggccagagguaggcuuggagucagaagauaa

SEQ ID NO: 6370 - RNA, 1671 nt, Artificial Sequence
  capsid_protein__Norovirus__CAR95870
augaagauggcgucgagugacgcugcuccaucuacggauggugcgggcaaccucguuccagagagucaacaagagguguugccccucgccccaguugcaggcgcugcguuagcggcaccugugguggggcaaacaaauauaauugaccccuggauuaaagaaaauuuuguucaagccccccagggugaguuuacugucucaccuaaaaauucuccuggugaaauuuuaguuaauuuggaauugggacccaaacucaaccccuaucuggaccaccuuucgcgcauguacaacucauaugcugguggcauagaugucauggugguguuggcgggcaacgccuucacagccggcaagguuuuaauagcagcuauccccccaaauuucccaguggaaggaguguccgcuucacaggccacucaauuuccccaugugauuauagauguuaggacacuugacccugugcggcucccccucccggaugugcgauccacauucuuccacuacacuaaugauacugaaccaaaaaugagguuaguuauuuggcuuuacaccccacucagaacuaauggcaguggugaugauucuuucaccgucucugggcgcauacucacaaggcccucccaggacuuugaauucgcuuuccuuauccccccaacaguggaaacaaagacaacccccuucucagugccaggcuucucggugcaggaaauguccaacucaagguggccagcugccaucucugcaauggucguccgugggaaugaaccccaaguuguucaguuccagaacggcagggcccaucuggaugguaugcugcuugguacgacaccugugucgcccaauuacauagcauccuaccgaggcauuuccacuggcaacucucguucugcuuccucugaggcugacgagagggcuguugguagcuuugauguguggguccgcuuacaagaaccugauggccagcccuaugacaucuuugguaagcagccagccccaauuggcaccccugauuucaaggcugugauaguuggcuuugcagcuaggccccucacauccggguccuaugcaaaugaagcguauguuaacaccacagccagugacuacgccccagccacugguaauaugcgcuucacagucaggaacggugggaccgggcacauaucugcaaacaaauacugggaguucaaaucauuugguguugaaggagaaaggcacacuaacauccaguaccaggaguaugagcuucccgauuauucuggccaaguugcuuccaaccauaaucuggcccccccuguagccccacgcaugccuggugagucauuauugcuuuuccaaucaaauaugccugugugggaugaugggcauggagaguccacacccaagaagauucauugccuauugccacaggaguuuauuggccauuucuuugauaaacaagcccccucccuaggugaugcugcacuacuuagguaugucaaccaggagacaaauagaguguuguuugaguguaaacuuuauagggaugguuacaucacagucgcugcaucaucaggauuauuagauuucccuuuggauggauucuuuagguuugauucuuggguuaguucuuuuuacauuuuaucccccgugggaagcggccaaggccgcagggguagagugagguuucaauaa

SEQ ID NO: 6371 - RNA, 1623 nt, Artificial Sequence
  capsid_protein_VP1__Norovirus__ADB27914
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggccccgaucugaaucccuaccuaucacauuuggccagaauguauaaugguuaugcaggugguuuugaagugcaggugauccucgcggggaacgcguucaccgccggaaaaauuauauuugcagcagucccaccaaauuuuccaacugaaggccugagucccagccagguuacuauguucccccacauaauaguagauguuaggcaauuggaaccuguguugauccccuuaccugauguuaggaauaacuucuaucauuauaaucagucaaaugauuccaccauuaaauugauagcaaugcuguauacaccacuuagggccaauaaugcuggggaugaugucuucacagucucuugucgaguccucacgaggccauccccugauuuugacuuuauauuuuuggugccaccuacaguugagucaagaacuaagccauuuacugucccaaucuuaacuguugaagaaaugacuaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcggguucucgcaauuacacaaugaauuuggcaucucuaaauuggaacaauuaugacccaacagaagaaauuccagccccucugggaacuccagauuucgugggaaagauccaaggugugcucacucagacaacaaagggagauggcucgacccggggccauaaagcuacaguuuacacugggagugccgacuuuacuccaaagcugggcaguguucaauuugguacugauacagaaaaugacuuugaaacucaccaaaacacaaaauucaccccagucggugucauccaggaugguagcaccacccaccgaaaugaaccccaacaaugggugcucccaaguuauucaggcagaaauguccauaaugugcacuuagccccugcuguagcccccaauuuuccgggugaacaacuucuuuucuucagguccacuaugcccggaugcagcggguaucccaacauggauuuggacugccuacucccccaggagugggugcagcacuucuaucaagaggcagcuccagcacaaucugauguggcucuauugagauuugugaauccagacacggguagaguccuguuugagugcaaacuucauaaaucaggcuaugucacaguggcucacaccggccaacaugauuuggucaucccccccaauggcuauuuuagauuugauuccuggguuaaucaauucuacacacuugcccccaugggaaauggaacggggcguagacgugcuuuauaa

SEQ ID NO: 6372 - RNA, 1623 nt, Artificial Sequence; identical to SEQ ID NO: 4415
  capsid_protein_VP1__Norovirus__ADI45809

SEQ ID NO: 6373 - RNA, 1623 nt, Artificial Sequence
  capsid_protein_VP1__Norovirus__ADI45810
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugaucccccuacccgauguuaggaauaauuucuaucacuacaaccaaucaaaugaccccaccaucaaauugauagcaauguuguauacaccacuuagggccaauaaugcuggggacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaacuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccaguuggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugacguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 6374 - RNA, 1623 nt, Artificial Sequence
  capsid_protein_VP1__Norovirus__ADI45813
augaagauggcgucgagugacgccaacccaucugauggguccacagccaaccucgucccagaggucaacaaugagguuauggcuuuggagcccguuguuggugccgccauugcggcaccuguggcgggccaacaaaauguaauugaccccuggauuagaaacaauuuuguacaagccccugguggagaguucacaguauccccuaggaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcaguuccaccaaacuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggagacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacucaacugucuccugucaacaucugcaccuucagaggggaugucacccauauugcagguagucgaaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguauacacugggagcgccgauuuugcuccaaaacuggguagaguucaauuugccacugacacagacaaugauuuugaugccaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggauguagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 6375 - RNA, 1608 nt, Artificial Sequence
  capsid_protein_VP1__Norovirus__ADT70684
augaagauggcgucgaaugacgccgcuccaucuaaugauggugcagccggucucguaccagaggucaacaaugagaccauggcacuugaaccgguggcuggggcuucaauagccgccccacucaccggucaaaauaauguuauagaccccuggauuagauuaaacuuugugcaggcccccaauggagaguuuacaguuucaccccgcaauucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacucuagaaccaguccuauugccucuuccagauguuaggaacaauuucuuucacuacaaucagcaaaacgaaccaaggaugagacuuguggcaaugcucuauaccccccuuagaucuaaugguucuggugaugauguauucacugucuccuguagagugcuuacucgacccucuccugauuuugauuucaauuauuugguacccccuacaguugaaucuaaaacuaaacccuucacacucccuaucuugaccauaggggaguuaaccaauuccagauucccugugccuauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagagaaccauguuuggaauaugcaagucaccaacauuaacggaaccccuuuugauccaacagaggauguuccagcuccucuagguacaccagacuuuucuggcaagcucuuuggcguccuaagccagagggaccaugacaaugccuguaggagccaugaugcagugauugcaacuaauucugcuaaauucaccccaaaauugggcgcuauacaaauuggcacaugggaacaagaugauguacacaucaaccaacccaccaaauuuacuccaguuggcuuguuugaaagugaagguuuuaaucaguggacgcuccccaauuauucuggagccuuaacacucaacaugggguuggcccccccuguggcccccacauuuccuggcgagcaaauucuuuucuucagaucccacauuccucuuaaaggagguguggcagacccaguuauugauugucucuugccccaggaguggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagguuugacucuuggguuaaucaguuuuauucucucgcccccaugggaacugggaaugggcgcagaagggugcaguaa

SEQ ID NO: 6376 - RNA, 1608 nt, Artificial Sequence; identical to SEQ ID NO: 4917
  capsid_protein_VP1__Norovirus__ADZ24003

SEQ ID NO: 6377 - RNA, 1623 nt, Artificial Sequence; identical to SEQ ID NO: 4636
  capsid_protein_VP1__Norovirus__AFI08234

SEQ ID NO: 6378 - RNA, 1623 nt, Artificial Sequence; identical to SEQ ID NO: 4720
  capsid_protein_VP1__Norovirus__AFI08237

SEQ ID NO: 6379 - RNA, 1623 nt, Artificial Sequence
  capsid_protein_VP1__Norovirus__AFI08243
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaacuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggcgcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgcuuuauaa

SEQ ID NO: 6380 - RNA, 1593 nt, Artificial Sequence; identical to SEQ ID NO: 4573
  capsid_protein_VP1__Norovirus__AFJ38516

SEQ ID NO: 6381 - RNA, 1620 nt, Artificial Sequence; identical to SEQ ID NO: 4866
  capsid_protein_VP1__Norovirus__AFJ38519

SEQ ID NO: 6382 - RNA, 1623 nt, Artificial Sequence; identical to SEQ ID NO: 4430
  capsid_protein_VP1__Norovirus__AFW15937

SEQ ID NO: 6383 - RNA, 1623 nt, Artificial Sequence; identical to SEQ ID NO: 4429
  capsid_protein_VP1__Norovirus__AFW15939

SEQ ID NO: 6384 - RNA, 1623 nt, Artificial Sequence
  capsid_protein_VP1__Norovirus__AFW15942
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacagugucucccagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaccacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccagcacaaucugauguggcucuauugagauuugugaauccagacacggguaggguccuguuugagugcaaacuucacaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 6385 - RNA, 1623 nt, Artificial Sequence; identical to SEQ ID NO: 4431
  capsid_protein_VP1__Norovirus__AFW15943

SEQ ID NO: 6386 - RNA, 1623 nt, Artificial Sequence; identical to SEQ ID NO: 4432
  capsid_protein_VP1__Norovirus__AFW15946

SEQ ID NO: 6387 - RNA, 1647 nt, Artificial Sequence; identical to SEQ ID NO: 5015
  capsid_protein_VP1__Norovirus__AFX71656

SEQ ID NO: 6388 - RNA, 1629 nt, Artificial Sequence; identical to SEQ ID NO: 5013
  capsid_protein_VP1__Norovirus__AFX71659

SEQ ID NO: 6389 - RNA, 1623 nt, Artificial Sequence; identical to SEQ ID NO: 4679
  capsid_protein_VP1__Norovirus__AFX81124

SEQ ID NO: 6390 - RNA, 1623 nt, Artificial Sequence; identical to SEQ ID NO: 4555
  capsid_protein_VP1__Norovirus__AFX81133

SEQ ID NO: 6391 - RNA, 1623 nt, Artificial Sequence; identical to SEQ ID NO: 4627
  capsid_protein_VP1__Norovirus__AFX81151

SEQ ID NO: 6392 - RNA, 1623 nt, Artificial Sequence; identical to SEQ ID NO: 4678
  capsid_protein_VP1__Norovirus__AFX81160

SEQ ID NO: 6393 - RNA, 1623 nt, Artificial Sequence
  capsid_protein_VP1__Norovirus__AFX81175
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucuaaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagacaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccacaaagcuacaguuuacacugggagugcccccuuuacuccaaagcugggcaguguucaauuuaguacugacacagaaaaugauuuugaaacucaccaaaacacaaaauucaccccagucgguguuauccaggaugguggcaccacccaccgaaaugaaccccaacaaugggugcucccaagcuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 6394 - RNA, 1623 nt, Artificial Sequence; identical to SEQ ID NO: 4644
  capsid_protein_VP1__Norovirus__AFX81184

SEQ ID NO: 6395 - RNA, 1623 nt, Artificial Sequence; identical to SEQ ID NO: 4512
  capsid_protein_VP1__Norovirus__AFX81187

SEQ ID NO: 6396 - RNA, 1623 nt, Artificial Sequence; identical to SEQ ID NO: 4719
  capsid_protein_VP1__Norovirus__AFX81217

SEQ ID NO: 6397 - RNA, 1623 nt, Artificial Sequence; identical to SEQ ID NO: 4709
  capsid_protein_VP1__Norovirus__AFX81220

SEQ ID NO: 6398 - RNA, 1623 nt, Artificial Sequence
  capsid_protein_VP1__Norovirus__AFX81223
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgccucuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggcgugcucacucaaaccacaaaagaagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaaauucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 6399 - RNA, 1623 nt, Artificial Sequence; identical to SEQ ID NO: 4659
  capsid_protein_VP1__Norovirus__AFX81235

SEQ ID NO: 6400 - RNA, 1623 nt, Artificial Sequence
  capsid_protein_VP1__Norovirus__AFX81259
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaacuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguugcucuauugagauuugugaauccagacacggguaggguccuguuugagugcaaacuucauaaaccaggcuaugucacaguggcucacaccggucagcaugauuuggucaucccccccaauggcuauuuuagguuugauuccuggguuaaucaguucuacacgcuugcccccaugggaaacggaacggggcguaggcgcgccuuauaa

SEQ ID NO: 6401 - RNA, 1623 nt, Artificial Sequence; identical to SEQ ID NO: 4499
  capsid_protein_VP1__Norovirus__AFX81280

SEQ ID NO: 6402 - RNA, 1623 nt, Artificial Sequence; identical to SEQ ID NO: 4651
  capsid_protein_VP1__Norovirus__AFX81286

SEQ ID NO: 6403 - RNA, 1623 nt, Artificial Sequence; identical to SEQ ID NO: 4711
  capsid_protein_VP1__Norovirus__AFX81310

SEQ ID NO: 6404 - RNA, 1623 nt, Artificial Sequence; identical to SEQ ID NO: 4728
  capsid_protein_VP1__Norovirus__AGE89469

SEQ ID NO: 6405 - RNA, 1623 nt, Artificial Sequence; identical to SEQ ID NO: 4692
  capsid_protein_VP1__Norovirus__AGE89484

SEQ ID NO: 6406 - RNA, 1623 nt, Artificial Sequence
  capsid_protein_VP1__Norovirus__AGE89487
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauucuaccauuaaguugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccaucccuuuggaaaaguuguucacgggccccagcggugccuuuguuguucaaccacaaaaugguaggugcacgacugauggcgugcucuuaggcaccacccaacugucuccugucaacaucugcaccuucagaggggaugucacccacauugcagguucucgcaauuacacgaugaauuuggcuucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguccaauucagcacugauacagaaaaugauuuugaagcucaccaaaacacaaaauucaccccagucggugucauccaggaugguggcaccacccaccgaaaugaaccccaacaaugggugcucccaagcuauucagguagagauguccacaauguacaccuggccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacacuggccagcaugauuuggucaucccccccaauggcuauuuuagguuugauuccuggguuaaucaauucuacacacuugcccccaugggaaauggaacggggcguagacgugcuuuauaa

SEQ ID NO: 6407 - RNA, 1623 nt, Artificial Sequence; identical to SEQ ID NO: 4565
  capsid_protein_VP1__Norovirus__AGE89619

SEQ ID NO: 6408 - RNA, 1623 nt, Artificial Sequence; identical to SEQ ID NO: 4674
  capsid_protein_VP1__Norovirus__AGE89670

SEQ ID NO: 6409 - RNA, 1623 nt, Artificial Sequence
  capsid_protein_VP1__Norovirus__AGE99596
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuuuggagcgcgcccuuaggcccugaucugaaucccuaccuaucucauuuggccagaauguauaaugguuaugcaggugguuuugaagugcagaugauccucgcggggaacgcguucaccgcgggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauccuaccauuaaauugauagcaaugcuguauacaccacucagggccaauaaugccggggaugaugucuucacagucucuugucgaguccucacgaggccauccccugauuuugacuucauauuucuggugccaccuacaguugagucaagaacuaaaccauuuacugucccagucuugacuguugaagaaaugaccaauucaagauuccccauuccuuuggagaaauuguucacgggucccagcagugccuuuguuguucaaccacaaaacggcagaugcacgacugauggcgugcucuuaggcaccacccagcugucuccugucaacaucugcaccuucagaggggaugucacccacauugcggguucccguaauuacacaaugaauuuggccucucuaaauuggaacaauuaugacccaacagaagagauuccagccccucugggaacuccagauuucgugggaaagauccaaggugugcucacucaaaccacaaagggagauggcucgacccggggccauaaagcuacaguuuacacugggagugccgacuucacuccaaagcugggcaguguucaauuugguacugauacagauaaugacuuugaaacucaccaaaacacaagauuuaccccagucggugucauccaggauggugcgaccacccaccgaaaugaaccccaacaaugggugcucccaaguuauucaggaagaaauguccauaauguacaccuagccccugcuguagcccccaauuuuccgggcgaacaacuucuuuucuucagguccacuaugcccggaugcagcggguaucccaacauggauuuggauugccuacucccccaggagugggugcaacacuucuaccaagaggcagcuccagcacaauccgauguggcucuauugagauuugugaauccagacacggguagggucuuguuugagugcaaacuccauaaaucaggcuaugucacaguggcucauaccggccaacaugauuuggucaucccccccaaugguuauuuuagguuugauuccuggguuaaucaguucuacacacuugcccccaugggaaauggaacggggcgcagacgugcuuuauaa

SEQ ID NO: 6410 - RNA, 1653 nt, Artificial Sequence; identical to SEQ ID NO: 5011
  capsid_protein_VP1__Norovirus__AGE99599

SEQ ID NO: 6411 - RNA, 1620 nt, Artificial Sequence; identical to SEQ ID NO: 4815
  capsid_protein_VP1__Norovirus__AGE99612

SEQ ID NO: 6412 - RNA, 1647 nt, Artificial Sequence; identical to SEQ ID NO: 5016
  capsid_protein_VP1__Norovirus__AGI17609

SEQ ID NO: 6413 - RNA, 1593 nt, Artificial Sequence; identical to SEQ ID NO: 4574
  capsid_protein_VP1__Norovirus__AGM33211

SEQ ID NO: 6414 - RNA, 1593 nt, Artificial Sequence; identical to SEQ ID NO: 4579
  capsid_protein_VP1__Norovirus__AGM33223

SEQ ID NO: 6415 - RNA, 1623 nt, Artificial Sequence; identical to SEQ ID NO: 4609
  capsid_protein_VP1__Norovirus__AGT17839

SEQ ID NO: 6416 - RNA, 1617 nt, Artificial Sequence; identical to SEQ ID NO: 4608
  capsid_protein_VP1__Norovirus__AGX85910

SEQ ID NO: 6417 - RNA, 1623 nt, Artificial Sequence
  capsid_protein_VP1__Norovirus__AHI59162
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacuggguagaguccaauuugccacugacacaaacaaugauuuugaaacuaaccaaaacacaaaauucaccccagucggcguuauccaggaugguaguaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggacuuggauugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6418 - RNA, 1620 nt, Artificial Sequence; identical to SEQ ID NO: 5036
  capsid_protein_VP1__Norovirus__AHI59165

SEQ ID NO: 6419 - RNA, 1623 nt, Artificial Sequence
  capsid_protein_VP1__Norovirus__AHX22044
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuugugcaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccacccaauuucccaacugaagguuugagccccagccaagucacuauguucccccacauaauaguagauguuaggcaauuggaaccuguguugauccccuuacccgauguuaggaauaauuucuaucauuauaaucagucaaaugacuccaccaucaaauugauagcaauguuguacacaccacuuagggcuaacaaugccggggacgaugucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggugaugucauccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaucaaaacacaaaguucaccccagucgguguuauccaggaugguagcacuaccccccgaaaugaaccccaacaaugggugcucccaaguuauucaggcagaaacacucauaaugugcaccuggcccccgcuguagcccccacuuucccgggcgagcagcuccucuucuucagauccaccaugcccggaugcagcggguaccccaacauggauuuggacugucugcucccccaggaaugggugcaguauuucuaccaggaggcagcuccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 6420 - RNA, 1623 nt, Artificial Sequence
  capsid_protein_VP1__Norovirus__AII02587
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucccauuuggccagaauguauaaugguuaugcagguggcuuugaagugcaggugauccucgcggggaacgcguucaccgccggaaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccacccacaguugagucaagaacuaaaccauuuacugucccaaucuuaacuguugaagaaaugaccaauucaagauuccccaucccuuuggaaaaguuguucacgggccccagcggugccuuuauuguucaaccacaaaaugguagaugcacgaccgauggcgugcucuuaggcaccacccaacugucuccugucaacaucugcaccuucagaggggaugucacccacauugcagguucucgcaauuacacgaugaauuuggcuucucuaaauuggaauaauuaugacccaacagaagaaauuccagccccacugggaacuccagauuucgugggaaagauccaaggugugcucacucaaaccacaaagggagauggcucgacccguggccauaaagcaacaguuuacacugggagugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauccccccuaauggcuauuuuagguuugauuccuggguuaaccaauucuacacacuugcccccaugggaaauggaacggggcguagacgugcuuuauaa

SEQ ID NO: 6421 - RNA, 1647 nt, Artificial Sequence
  capsid_protein_VP1__Norovirus__AII02617
augaagauggcgucgaaugacgccgcuccaucuaaugauggugccgccggccucgucccagagaucaacagugaggcaauggcgcuagaaccaguggcgggugcagcgauagcagcaccccucacuggucagcaaaauauaauugaucccuggauuaugaauaauuuugugcaagcaccugguggugaguucacaguauccccuagaaauuccccuggugaaguucuucucaauuuggaauuggguccagaaauaaaucccuacuuggcccaucuugcuagaauguauaaugguuaugcagguggauuugaagugcaggugguccuagcuggaaaugcguuuacagcaggaaagauaaucuuugcagcuauucccccuaauuuuccaauugauaaucuaagugcagcacagaucacaauguguccacaugugauuguggauguuagacagcuggaaccagucaaccucccgaugccugacguucgcaauaacuuuuuccauuacaaucaggggucugauucgagauugcgccuaauugcaaugcuauauacaccucuuagggcaaauaacucuggggaugauguuuucacugugucuugcagagugcuaacuagaccuaguccugacuucucauuuaauuuccuugugccacccacuguggagucaaagacaaaacccuuuucccuccccauucugacuaucucugaaauguccaauucuagguucccaguaccaauugauucucugcacaccagcccuacugagaacauuguuguccagugccagaauggacgcgucacccuugauggugaguugaugggcaccacccaacuuuuaccuagccaaaucugugcuuucaggggcaugcucaccagaucaacaagcagggccagugaccaggccgauacagcaaccccuagauuguuuaauuauuauuggcauauacaacuggauaaccuaaauggaacuccuuaugacccugcagaagauauaccaggcccccuagggacaccagauuuccggggcaaagucuuuggcguggccagccagagaaauccugaugccacgacuagggcacaugaagcaaagauagacacaacaucuggccgcuucaccccaaaauuaggcucacuagagauuuccacugagucuggagauuuugaucaaaaccaaccaacaagauucaccccaguuggcauugggguugaccaugaggcagauuuucaacaauggacucuucccgacuaugcuggccaguucacccacaacaugaacuuagccccagcuguugcucccaacuucccuggugagcagcuccuuuucuuccgcucacaguugccaucuucuggugggcgguccaacgggauucuagacugccuggucccccaagaauggguacagcacuucuaccaagaaucagcccccucccaaacucaaguggcccugguuagguaugucaacccugacacugguagaguguuauuugaggccaagcugcacaaauuagguuucaugacuauagccaagaguggugacucuccaauaacuguccccccaaauggauacuucagguuugaaucuugggugaaccccuuuuauacacuugcccccaugggaacugggaaugggcguagaaggauucaauaa

SEQ ID NO: 6422 - RNA, 1647 nt, Artificial Sequence; identical to SEQ ID NO: 4731
  capsid_protein_VP1__Norovirus__AIS24556

SEQ ID NO: 6423 - RNA, 1623 nt, Artificial Sequence
  capsid_protein_VP1__Norovirus__BAI49908
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauacuauggagcgcgccccuaggcccugaucugaauccauaccuuucucaccuggccagaauguacaaugguuaugcaggugguuuugaagugcagguaauccucgcggggaacgcguucaccgcugggaaaaucauauuugcagcagucccaccaaauuucccaacugaaggcuugagccccagccaggucacuauguucccccauauaauaguagauguuaggcaauuggagccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuuuacuccaaagcuaggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuggccccugcuguagcccccacuuuuccgggugagcaacuucuuuucuucaggucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuugguuaucccccccaauggcuacuuuagauuugauuccugggucaaccaguuuuacacacuugcccccaugggaaauggagcggggcguagacgugcauuauaa

SEQ ID NO: 6424 - RNA, 1623 nt, Artificial Sequence
  capsid_protein_VP1__Norovirus__BAI49913
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcugcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuucccauuccuuuggaaaaauuguucacgggucccagcagugccuuugucguccaaccacaaaacggcaggugcacgacugauggcgugcucuuaggcacuacccaacugucccccgucaacaucugcaccuucagaggagaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuucacuccaaagcugggcagcguucaguucgccacugacacagacaaugauuuugaaacuggccaaaacacaagguucaccccagucggugucauccaggaugguaguaguacccacagaaaugaaccccaacaauggguacucccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggccagcaugauuuggucaucccccccaauggcuacuuuagauuugauuccugggucaaccaguucuacacacuugcccccaugggaaauggagcggggcguagacgugcauuauaa

SEQ ID NO: 6425 - RNA, 1623 nt, Artificial Sequence
  capsid_protein_VP1__Norovirus__BAI49922
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaacccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6426 - RNA, 1608 nt, Artificial Sequence
  capsid_protein_VP1__Norovirus__BAJ25074
augaagauggcgucgaaugacgcuaauccguccagugacggaucagccaaccucgucccagagaucaguaaugagguuauggcccuugaaccaguagcuggugcugcuauugcugccccaguugcuggacaacaaaacauaauagaucccuggauuagaaacaauuuuguacaggccccugguggugaauucacuguuucaccaagaaacgccccgggggaaguacuucuaaauuuacccuugagcccugacaucaauccauauuuggcccaucuguccagaauguacaacgguuacgcuggaggcguggagguggaggugguccucgccgggaaugcguucacggcgggaaaaaucaucuuugccgcagugccaccaaauuuuccuccugagaaccuuagcccaagucaaauaacaauguuaccccacaucauaguugaugucaggcaauuggagccaguacgcauaccccuaccagaugugcgcaacaauuuuuaccacuacucuagagagaaugacuccacauugagguugauugcaauguuguauacuccccucagggccaauaaugcuggugaugauguguucacuguuucuugcaggguguugacaaggcccucucccgauuuugauuuuauauuccuggugccacccacaguugaaucuaaaucuaaacccuucaccauuccaaugcucaccauugaggagaugacuaauucuagguucccugccccauuagaacugaugaccacggggccgagucacgacauuguugugcagccgcaaaacggacgcugcaccaucgaugguguguuacucggcaccacacaguuguccccagucaacauuugcucucugaggggcguccccaccaagcgaaccaauggaaaugacaacuguuuugugcaacuugaaaacccuaaugguucagcuuacgacccaacagaggacauaccugcuguuuuggggucaccugauuuugugggagagcucuacgggacgaucacucagaggagcucggauaacucaacuagagcccacccuuuuacccucaacacuggaagcccuagguauacucccaagauuggcucaguggacauccgcgucacagacguuagugaccuccaagaccaugauccagugaaacucacuccaguuggccucucuggggacagagguucgauccaucaguggcaacuuccaaauuauucaggaguagcaacccauaacaugcauuuggccccauccguugcuccauuguuuccuggugaacagauucuuuucuuccgguccacaguccccgggugcggugguuauccaaacucaaacaucgauugcuugauuccucaggaguggguccaacauuucuaucaggagggugccccagcccgcaccgauguggccuugcucagauucauaaacccugacacgggcaggguacucuuugagugcaaauugcauaaacauggcuuuauuacuguggcuuacucuggaaaucaugaucuggucaugcccccaaauggcuauuuuagauuugaaucuugggugaaucaauuucacacucuugcccccaugggaacaggcucgggcagaaggaggauccaguaa

SEQ ID NO: 6427 - RNA, 1617 nt, Artificial Sequence
  capsid_protein_VP1__Norovirus__BAP33934
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagauuacaaugcucccacauuuaauaguagaugucaggacucuugaaccaauuaugaucccacucccugauguuaggaauacauucuuccauuauaacaaccagccuaacagccgcaugagauuaguggcuaugcucuacaccccccuuagaucuaauggcucaggugaugaugucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaauggcacaacauaugacccaacugaugaugugccagccccgcuggguacaccugacuucaagggcgucguguuugggguagcaagccaaagaaauguggguaaugaugcgccuggcucaaccagggcccaugaggcggugauuucaaccuauagcccccaauuuguccccaaguuagguucugucaauuuuagaaguaaugauaaugauuuccaauugcagccgacaaaauucacaccagugggcaucaaugacgauggugaccacccguucagacagugggaacuaccagacuauucagggcugcuuaccuugaauaugaaccuugcccccccgguugcuccaaauuucccuggugaacaauuauuauucuucagaucuuuugugccaugcucaggagguuauaaccaaggcauuguagauugucuuauuccccaagaauggauccaacacuucuaucaggaaucagcgcccucccagucagacguggcccuaaucagguaugucaaccccgauacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 6428 - RNA, 1623 nt, Artificial Sequence
  major_capsid_protein__Norovirus__ABQ63283
augaagauggcgucgagugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccacuuggccagaauguacaaugguuaugcaggugguuuugaagugcagguaauucucgcggggaacgcguucaccgcuggaaaaauuguauuugcagcagucccaccaaauuucccaacugaaggcuugagccccagccaggucacuauguucccccauauaauaguagauguuaggcaacuggaaccuguguugauccccuuacccgauguuaggaauaauuucuaucauuacaaucaaucaaaugaccccaccaucaaguugauagcaauguuguauacaccacuuagggcuaauaaugcuggggaagaugucuucacaguuucuugucgaguucucacgagaccaucccccgauuuugauuucauauuuuuggugccacccacaguugagucaagaacuaaaccauucucugucccaauuuuaacuguugaggagaugaccaauucaagauuccccauuccuuuggaaaaguuguucacgggucccagcaguaccauuguuguucaaccacaaaauggcagaugcacgacugauggcgugcuccuagguacuacccaacugucuccugucaacaucugcaccuucagaggggaugucacccacauugcaggcacucaagaauacacaaugaaucuggccucccaaaacuggaacaauuacgacccaacagaagaaaucccagccccucugggaacuccagauuucgugggaaagauccaaggcgugcucacccaaaccacaaggagggauggcucgacccgcggucacaaagcuacagugagcacuggaagugucaacuucaccccaaagcugggcagaauucaauucuccacugauacaagcaaugacuuugaaacuggccaaagcacgagauucaccccagucgguguuguccaggauggcaguaccacccaccaaaaugaaccccaacaaugggugcucccagauuauucagguagggacagucauaauguacaccuagccccugccguggccccuucuuuuccgggcgagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagauacagguaggguucuguuugaguguaagcuucauaagucaggcuauguuacaguggcucacacuggccagcaugauuugguuaucccccccaauggcuauuuuagauuugauuccugggucaaccaguucuacacacuugcccccaugggaaauggaacggggcguagacgugcauuauaa

SEQ ID NO: 6429 - RNA, 1623 nt, Artificial Sequence
  major_capsid_protein__Norovirus__ABV55634
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaaccaaaccauuuacugucccaaucuuaacuguugaagaaaugaccaauucaagauuccccauuccuuuggaaaaguuauucacgggucccagcggugccuuuguuguucaaccacaaaauggcagaugcacgacugauggcgugcucuuaggcacuacccaacugucuccugucaacaucugcaccuucagaggggaugucacccacauugcagguucucguaauuacacaaugaauuuggcuucucuaaaauggaacaaauaugacccaacagaagaaauuccagccccucuaggaacuccagauuucgugggaaagauccaaggugugcucacucaaaccacaaagggagauggcucgacccguggccauaaagcuacaauuuacacugggagugcccccuuuaccccaaagcugggcaguguucaauucaguacugauacagaaaaugauuuugaaacucaccaaaacacaaaauucaccccagucgguguuacccaggaugguagcaccacccaccgaaaugaaccccaacaaugggugcucccaaguuacucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 6430 - RNA, 1623 nt, Artificial Sequence
  major_capsid_protein__Norovirus__ACV41093
augaagauggcgucgaaugacgccaacccaucugauggguccacagccaaccucgucccagaggucaacaaugagguuauggcuuuggagcccguuguaggugccgcuauugcggcaccuguagcgggccaacaaaauguaauugaccccuggauuagaaauaauuuuguacaagccccugguggagaguuuacaguguccccuagaaacgcuccaggugagauacuauggagugcgcccuugggcccugauuugaacccuuaccuuucucauuuggccagaauguacaaugguuaugcaggugguuuugaggugcagguaauccuugcggggaacgcguucaccgccgggaaaaucauauuugcagcagucccaccaaacuuuccaacugaaggcuugagccccagccagguuacuauguucccccacauaauaguggauguuaggcaauuggaaccuguguuaauccccuuaccugauguuaggaacaauuucuaucacuacaaccaaucaaaugacccuaccaucaaauugauagcaaugcuguacacaccacuuagggccaauaaugccggggaugaugucuucacagucucuugucgaguacucacgaggccauccccugauuuugauuucauauuucugguaccgccaacaguugaaucaagaaccaaaccauuuacugucccaaucuuaacuguugaggaaaugaccaauucaagauuccccauuccuuuggagagguuguacacgggccccagcagugcuuuuguuguccaaccacaaaacggcaggugcacgacugauggcgugcucuuaggcaccacccagcugucugcugucaacaucugcacuuuuagaggagauguuacucacauugcaggcucucgcaauuauacaaugaauuuggccucucaaaauuggagcaacuaugacccaacagaagaaaucccagccccccuggggaccccagauuuugugggaaagauccaaggcaugcucacccaaaccacaggaagagauggcucgacccgcggccacaaagccacagugcucacugggagugccgacuuugccccaaaauugggcaggguccaauucgccacugacacagacaacgauuucgagucuggcgaaaacacgaaauucaccccagucggcgucauccaggaugguuccaccacccaccggaaugaaccccaacaaugggugcucccaaauuacucagguagaacuggucauaaugugcaucuagccccugccguugcccccacuuacccgggugagcaacuccuuuucuucaggucuacuaugcccggaugcagcggguaucccaacauggauuuggauugccuacucccccaggagugggugcggcacuucuaccaagaggcagcuccggcacaaucugacguggcucuauugagauuugugaauccagacacgggcagaguccuguuugagugcaaacuucauaaaccaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6431 - RNA, 1635 nt, Artificial Sequence
  major_capsid_protein__Norovirus__ACV41096
augaugauggcgucuaaggacgcuacaccaagcgcagauggcgccacuggcgccggccagcugguaccggagguuaauacagcugacccuauacccauugacccuguggcuggcuccucuacagcccuugccacugcgggccaaguuaauuugauugaucccuggauaaucaauaauuuugugcaagccccucagggcgaguucacaauauccccaaauaauacccccggugaugugcuauuugauuugcaguuagggccucaucugaauccuuuccuuucccaucuuucucagauguacaauggcugggugggcaacaugcgaguacguguuguuuuggcugguaaugcuuuuacagcuggaaagguuauaauuuguuguguucccccuggcuuucaaucucgcacucuuuccauagcucaggcuacucuauuuccccaugucauugcugauguuaggacccuugauccuguagaagugccccuugaagauguuaggaauguguuguaucauaauaaugacacccaaccuaccaugcgccuccuuugcauguuguacaccccucuucgaacugggggggcgucuggugggacugauucuuuugugguagcuggacgugugcuuacuugcccaggcccugacuuuaacuucuuauuccuaguuccucccacagucgagcaaaagacucgcccuuuuacugugccuaauaucccuuugaaguaucugucuaauucuaggaucccaaacccuauugaggguaugucuuugucaccugaccagacccaaaauguucaauuccagaaugguagguguacaauugacggucagccccucgggaccacaccugucucaguuagccaguuauguaaguuuagggguaggauuacaucuggacagagggugcucaauuugacagaguuagaugguucaccuuuuauggccuuugccgcccccgcccccgcgggcuuuccagaucucggaucuugugauuggcauauugaaaugaguaagauuccaaacuccagcacccagaacaauccaauaguaguuaauucugucaaacccaauagucaacaguuugucccgcauuugucaaguaucacccuugaugauaauguuucuagugggggugacuauauuggcacuauacaauggaccucuccuccuucugauuccggcggagccaacacaaauuuuuggaagauuccugacuaugggucuagccuagcagaagccucacagcuggcccccgcuguuuauccgccugguuucaaugaggugauuguguacuuuauggcaucuauaccuggucccaaucaaucugguucccccaauuuggugccaugccuucucccccaggaauauauaacacauuuuaucagugagcaggcccccauucagggugaggcugccuuacuccauuauguagacccagacaccaaucguaauuugggugaauucaaguuguauccuggugguuaucugacuuguguuccuaauaguucuaguacaggaccucaacagcuuccucuugaugguguguuugucuuugcuucuuggguuucuagauuuuaucaauuaaagccugugggaacagccggaccggcuagagguaggcuugguguccgcagauaa

SEQ ID NO: 6432 - RNA, 1743 nt, Artificial Sequence
  major_capsid_protein__Norovirus__ACV88130
augaagauggcgucuaaugacgccacggcuccaucucaggauggggcggccaaccucguuccagagagucagcaugagguuuuggccuuggagccaguugccggggcagcacuugccgcccccguggcuggacaauuuaaugccauugaccccuggauuaagcaaaauuuuguccaagccccagccggggaguuuacggugucaccacguaaugccccuggagagauccuuauggaucucgagcuuggcccugaauugagccccuuucuggcacaccuugcacagauguacaacgccuaugcuggagggauggaagugcagauaauccuugcggggaaugcguucacugcagguaagauaauagucugugcuguaccaccaaauuuuccaccagaucggcugucugccucccaggccacaaacuucccacauguuaucauggaugucaggacguuagagccagugauccuccccuugccugacguucgcgcuggcuucuuccacuauaaccagcugagagagccgcgcaugcgacucauggcccuccuuuacacaccucugagagccaaugggacuggagacgaugccuucaccgucucguguagggugcucacgcgcccuaugcaggauuuugaguucauguuccucgucccaccaaccgucgagucucgugucaccccuuuuucagugccaaccuacccugugguggagaugacaaacuccagauggccagccaggauuucaggcaugcaugucaacgcaaaccaaacccuggcuguccaauuucagaauggcaggugcacccuggauggccagcucauggggaccacgcagcucugugccgccgaugucugcaggaugaggggucgauauacuuccaccagagccgaccuugcagggguugaccacaccgaccaggguccgucccugggagcuggaccuucaaaugaucccgucaguguuccggaggcgcggucucagaccaggacuagugucagcgcacaccuacaacuugaagagcugaauggccaaccuuaugaagucuauggagagcaaccagcaccacucgggaccccagacuuuugcuguaggcugaugggagagcuugucagacugccauccaccagcccggcagcccagucgagguuccgugacgccuucuuugacaccuauggcgcgcucuuugccccagcggugggcuccacgaccuucacggucaacaacagcuccaccucagacuuugccaauggccaacccuucgaguucuugccaauuggaguugagaucggaaacucugcucaguaugaugaguuugcacugcccagcuacaacggggccauaggggagaaucgccaccucgccccugucgcggccccgggguuuccuggugaaaacauagucuuuuucuccuccaaucuuccagugugggauuccaccuccgcgcagaacaacaggaggaucucaugccuguugcccaaugaguuuguccagcacuucuaugaccuccaggcaccgucccaguccgacguggcccuucugagguauguccacccugagucuggucgaguucuauucgagugcaagcuguacagagaugguuuucucacugucaauggggcaagccucgcagaauucccagucaacggguacuucagauuugacucaugggugaaccaauucuucacacucagcccugugggaacuggcuccggccguagugggcgcucucgcaacgcccaauaa

SEQ ID NO: 6433 - RNA, 1623 nt, Artificial Sequence
  major_capsid_protein__Norovirus__ACW19927
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggggaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuagacaauuggaaccuguguugauccccuuaccugauguuaggaauaacuucuaccauuauaaucagucaaaugauucuaccauuaaauugauagcaaugcuguauacaccacuuagggcuaauaaugcuggggaagaugucuucacagucucuugucgaguccucacgaggccaucccccgauuuugauuucauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucagccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugccgacuucacuccaaagcugggcaguguucaauucagcacugauacagaaaaugauuuugaaacucaccaaaacacaaaauucaccccagucggugucauccaggauggcagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagccccagcacaaucugauguggcucuauugagauuugugaauccagacacggguaggguccuguuugagugcaaacuucauaaaucaggcuaugucacaguggcucacaccggccagcacgauuuggucaucccccccaauggcuauuuuagguuugauuccuggguuaaucaauucuacacacuugcccccaugggaaauggaacggggcguagacgugcuuuauaa

SEQ ID NO: 6434 - RNA, 1623 nt, Artificial Sequence
  major_capsid_protein__Norovirus__ACX31885
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguucacaguguccccuagaaaugcuccaggugagauacuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcaguuccaccuaacuuuccaacugaaggcuugagccccagccagguuacuauguucccccauauaauaguagauguuaggcaauuggaaccuguguuaauccccuuaccugauguuaggaauaacuucuaucacuacaaccaaucaaaugacccuaccauuaaauugauagcaaugcuguacacaccacuuagggcuaauaaugcuggggaugaugucuucacagucucuugucgaguccucacgagaccauccccugacuuugauuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuaggcaccacccagcugucugcugucaacaucugcaccuuuagaggggaugucacccacauugcaggcucucgcaauuauacaaugaauuuggccucucaaaauuggaacaacuaugauccaacagaagaaaucccagccccccugggcaccccagauuucgugggaaagauccaaggcaugcucacccaaaccacaagaagugauggcucgacucgcggccacaaggccacagugcucacugggagugccgacuucgccccaaaauugggcagaguccaauucgccacugacacagacaacgauuucgaaucuggccaaaacacgaaauuuaccccaguuggcgucauccaggaugguuccacuacccaccgaaaugaaccucaacaauggguacucccaaauuacucagguagaacuggucauaaugugcaucuagccccugcuguugcccccacuuacccgggugagcaacuccuuuuuuucagguccacuaugcccggauguagcggguaccccaacauggaucuagauuguuugcucccccaggagugggugcagcacuucuaccaagaagcagcuccagcacaaucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacuugcccccaugggaaauggaacggggcguagacgugcuuuauaa

SEQ ID NO: 6435 - RNA, 1623 nt, Artificial Sequence
  major_capsid_protein__Norovirus__ACX31887
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacaucugcaccuucagaggggaugucacccacauugcaggcucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacagucuacacugggagugcccccuuuacuccaaagcugggcaguguccaauucaguacugacacagaaaaugauuuugaaacucaccaaaacacaaaauucaccccagucggugucauccaggaugguggcaccacccaccgaaaugaaccccaacaaugggugcucccaaauuauucagguagaaaugucccuaauguacaccuagccccugcuguagcccccacuuuuccgggugaacaacuucuuuucuuuagguccacuaugcccggauguagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucauacuggccagcaugauuuggucauccccuccaaugguuauuuuagguuugauuccuggguuaaucaauucuacacacuugcccccaugggaaaugggacggggcguagacgugcuuuauaa

SEQ ID NO: 6436 - RNA, 1623 nt, Artificial Sequence
  major_capsid_protein__Norovirus__ACX31891
augaagauggcgucgagugacgccagcccaucugauggguccgcagccaaccucgucccagaggucaacaaugagguuauggcucuggagcccguuguuggugccgcuauugcggcaccuguagcgggccaacaaaacauaauugaccccuggauuagaaauaauuuuguacaagccccugguggagaauucacagugucccccagaaaugcuccaggugaaauacuauggagcgcaccuuuaggcccugauuugaaucccuaccuuucccauuugucuagaauguauaaugguuaugcaggugguuuugaagugcaagugauccucgcggggaacgcguucaccgccgggaaggucauauuugcagcagucccuccaaacuuuccaacugaaggucuaagcccuagucaaguuaccauguucccccauauaauuguagauguuagacaauuggagccuguguugauuccccuaccugauguuaggaauaauuuuuaccauuacaaucaaacaaaugacccuaccauuaaauugauagcaauguuguauacaccacuuagagcuaauaaugcuggggacgaugucuucacagucucuugucgaguccucacgagaccauccccugauuuugacuucauauucuuagugccacccacaguugaauccagaacuaaaccauuuacugucccaaucuuaacuguugaggaaaugaccaacucuagauuccccauuccuuuggaaagguuguacacgggucccagcagugcuuuuguuguccagccacaaaauggcaggugcacgacugauggcgugcucuuaggcaccacccagcugucugcugucaacaucugcaccuucaggggggaugucacccacauuacaggcucccguaauuauacaaugaauuuggccucucaaaauuggaacaauuaugacccaacagaagaaauuccagccccucuggggaccccagauuuugugggaaagauccaaggcaugcucacccaaaccacaagaggagauggcucgacucguggccacaaagccacaguguacacugggagugccgacuucgccccaaaauugggcagaguucaauucgcuacugacacagacaaugauuuugaauccaaccaaaacacaaaauucaccccagucggugucauccaggauggcaacaccacccaucaaaaugaaccccaacaauggguacucccagguuacucagguagagauggccacaauguacaccuagccccugccgucgcccccaccuacccgggugagcaacuccuuuucuuuagguccaccaugcccggauguagcggguaucccaacaugaaucuagauugcuuacucccccaggaaugggugcagcacuucuaccaagaagcagcuccagcacaaucugaaguggcucugcuaagauuugugaauccagauacagguaggguuuuguuugagugcaagcuccauaaaucaggguaugucacaguggcucauacuggucagcaugauuugguuauuccccccaaugguuauuuuagauuugauuccugggucaaccaguuuuacacacuugcccccaugggaaauggagcggggcguagacgugcauuauaa

SEQ ID NO: 6437 - RNA, 1623 nt, Artificial Sequence
  major_capsid_protein__Norovirus__ACZ37232
augaagauggcgucgaaugacgcagcuccaucuaaugauggugcagcaggccucguaccagagaucaacaaugaggucaugccccuugagcccguggcuggugcaucgcuggcgacaccaguuguugggcaacaaaauauaauugaucccuggauaagaaauaauuuuguacaagcuccugcaggugaguuuacaguuucccccagaaauuccccuggugaaauuuugcuugauuuggaguugggaccagaauugaaccccuaucucgcucaucuggcccgcauguauaaugggcacgcugguggcauggaagugcaaauuguguuagcugggaacgcguucacagcuggcaagaucauauuugcugccaucccuccaggguucccauaugaaaauuugucaccuucacaaauuacgauguguccucauguuauaauugauguuagacaauuagaaccaguccuacuaccuaugccagacaucagaaauaacuucuuccauuauaaucaggguaaugauccaaaauugagauuaguagcuaugcuuuacaccccuuuaagggcuaauaauucuggugaugauguguucacaguuucuuguaggguccucacuaaaccgucaccugauuuugaauuuacauuuuuaguucccccuacgguugaauccaagaccaagcaguucacauugcccauccucaaaauaucagagaugaccaacucaagauuuccagugccaguggaaaugauguacacagccaggaaugagaaccaaguuguccagccacagaauggaagggucacacuugauggcgagcuauugggcaccacacccuuguuggcugucaacaucugcaaguucaagggagagguuauagcuaagaauggagaugugagauccuacaggauggacauggaaaucaccaacaccgauggcaccccaauugaccccacagaagacacaccuggucccauugguucaccugauuuucaaggcauacucuuuggcguugcgagccagcgcaacacgaaugagccaaaucccgccacgagagcccaugaagccaacauuaacacugguggggaccaauaugcccccaaauuggcccaagugaaauucuucucagagucccaggauuucgaggugcaccagcccacagucuucaccccaguugguguggcaggcgacacuucccacccuuucagacaauggguccugccucgguacgguggacaucugaccaauaacacccacuuggcuccagcaguggccccucuauucccaggugagcagauucuguucuuuagaucacaaauaccuagcucaggcggccaugaauuggguuacauggacugccucgucccacaagaauggguccaacacuucuaucaagaagcugccacagcucagucugagguagcacucauaagguucaucaacccagauacuggcagaguccucuuugaggccaagcugcauaagcaaggcuuuauaacuguggcucacacuggugacaacccaauugucaugccaccaaauggguacuuuagauuugaagccuggguuaaucaguuuuacucacuugcccccgugggaacugggaaugggcgcaggaggauccaauaa

SEQ ID NO: 6438 - RNA, 1623 nt, Artificial Sequence
  major_capsid_protein__Norovirus__ADD10375
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugacuugguuaucccccccaaugguuauuuuagauuugauuccugggucaaccaguucuacacacuugcccccaugggaaaugggacggggcguagacgugcauuauaa

SEQ ID NO: 6439 - RNA, 1623 nt, Artificial Sequence
  major_capsid_protein__Norovirus__ADO85552
augaagauggcgucgagugacgccaacccaucugauggguccacagccaaccucgucccagaggucaacaaugagguuauggcuuuggagcccguaguuggugccgccagugcggcgccuguagcgggccaacaaaauguaauugaccccuggauuagaaacaauuuuguacaagccccugguggagaguuuacagaauccccuacaaacgcuccaggugaaauauuauggagcgcgcccuuaggcccugaucugaaccccuaccuuucccauuuggccagaauguacaaugguuaugcaggugguuuugaagugcagguaauccucgcggggaacgcguucaccgccgggaaaaucauauuugcagcaguuccaccaaauuucccaacugaagguuugagccccagccaggucacuauguuuccccauauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugcuggggaugaugucuucacaguuucuugucgaguucucacgagaccaucccccgauuuugauuucauauuuuuggugccagccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacuguccccugucaacaucugcaccuucagaggggaugucacccauauuccagguagucguaacuacacaaugaauuuggccucccaaaauuggaacaguuacgauccaacagaagaaaucccagccccuguaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgaacaacuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugccccuaugggaaaugggacggggcguagacgugcauuauaa

SEQ ID NO: 6440 - RNA, 1623 nt, Artificial Sequence
  major_capsid_protein__Norovirus__ADQ43779
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacagugucccccagaaacgcuccaggugaaauauuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaacgcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacuacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggcgcucccaaguuauucagguagaaauguccagaauguacaccuagccccugcuguagcccccacuuuuccgggugaacaacuucuuuucuuuagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugaguguaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacgugcuuuauaa

SEQ ID NO: 6441 - RNA, 1623 nt, Artificial Sequence
  major_capsid_protein__Norovirus__ADQ43781
augaagauggcgucgagugacgccaacccaucugauggguccacagccaaccuugucccagaggucaacaaugaaguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguggauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6442 - RNA, 1623 nt, Artificial Sequence
  major_capsid_protein__Norovirus__ADQ43783
augaagauggcgucgagugacgccaacccaucugauggguccacagccaaccucgucccagaggucaacaaugagguuauggcuuuggagcccguuguuggcgccgcuauugcggcaccuguagcgggccaacaaaauguaauugaccccuggauuagaaauaauuuuguacaagcuccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguuuccccauauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuuuauauuuuuagugccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggacgucacccauauuacaggcagucguaauuacacaaugaauuuggcuacucaaaacuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaauucaccccagucggugucauccaggauggugauacugcccaccgaaaugagccccaacaaugggugcucccaaguuacucaggcagaaauagucacaaugugcaccuggcccccgcuguagcccccacuuuuccgggugagcaacuccucuucuucagauccacuaugcccggaugcagcggguacccuaacauggauuuggacugucugcucccucaggaauggguacaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcuuuauaa

SEQ ID NO: 6443 - RNA, 1623 nt, Artificial Sequence
  major_capsid_protein__Norovirus__ADV37805
augaagauggcgucgagugacgccaacccaucugauggguccacagccaaccucgucccagaggucaacaaugagguuauggcuuuggagcccguuguuggugccgccauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguacucacgagaccaucccccgauuuugauuucauauuucuagugccacccacaguugaaucaagaacuaaaccauucucugucccaauuuuaacuguugaggagaugaccaauucaagauuccccauuccuuuggaaaagcuguucacgggccccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggccacaaagcuacaguguacacugggagcgccgacuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggcgagcaacuucucuucuucagauccacuaugcccggaugcagcggguaccccaacauggauuuggacugucugcuuccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuucagauuugauuccugggucaaccaguucuacacacuugcccccaugggaaauggaacggggcguagacgugcauuauaa

SEQ ID NO: 6444 - RNA, 1623 nt, Artificial Sequence
  major_capsid_protein__Norovirus__ADV37807
augaagauggcgucgagugacgccaacccaucugauggguccacagccaaccucgucccagaggucaacaaugagguuauggcuuuggagcccguaguuggugccgccauugcggcgccuguagcgggccaacaaaacguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucggguacucacgagaccaucccccgauuuugauuucauauuucuagugccacccacaguugaaucaagaacuaaaccauucucugucccaauuuuaacuguugaggagaugaccaauucaagauuccccauuccuuuggaaaagcuguucacgggccccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggccacaaagcuacaguguacacugggagcgccgacuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggcgagcaacuucucuucuucagauccacuaugcccggaugcagcggguaccccaacauggauuuggacugucugcuuccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuucagauuugauuccugggucaaccaguucuacacacuugcccccaugggaaauggaacggggcguagacgugcauuauaa

SEQ ID NO: 6445 - RNA, 1623 nt, Artificial Sequence
  major_capsid_protein__Norovirus__ADV37809
augaagauggcgucgagugacgccaacccaucugauggguccacagccaaccuugucccagaggucaacaaugagguuauggcuuuggagcccguuguuggugccgccauugcggcaccuguagcgggccaacagaauguaauugaccccuggauuagaaacaauuuuguacaagccccuggcggagaguucacaguauccccuagaaacgcuccaggugaaauacuauggagcgcgcccuuaggcccugauuugaaucccuaccuuucccauuuggccagaauguacaauggcuaugccggcgguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugauggcgugcuccuagguaccacucaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgacuucgcuccaaaacuggguagaguucaauuugccacugacacagacaaugauuuugaugcuaaccaaaacacaaaguucaccccagucgguguuauccaggauggugacacugcccaccgaaaugaaccccaacaaugggugcucccaaguuacucaggcagaaauagucacaaugugcaccuggcccccgcuguagcccccacuuuuccgggugagcaacuccucuucuucagauccacuaugcccggaugcagcggguaccccaacauggauuuggacugucugcucccccaggaaugggugcaguacuucuaucaagaggcagccccagcacaaucugauguggcuuugcuaagauuugugaauccagacacagguaggguuuuguuugaguguaagcuucauaaaucaggcuauguuacaguggcucacaccggccaacaugauuuaguuaucccccccaaugguuacuuuagauuugauuccugggucaaccaguucuacacacuugcccccaugggaaauggaacggggcguagacgugcauuauaa

SEQ ID NO: 6446 - RNA, 1623 nt, Artificial Sequence
  major_capsid_protein__Norovirus__ADV37813
augaagauggcgucgagugacgccaacccaucugauggguccacagccaaccucgucccagaggucaacaaugagguuauggcuuuggagcccguaguuggugccgccauugcggcaccuguagcgggccaacaaaacguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucuguuccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugaucuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucagguuauguuacaguggcucacacuggccagcaugauuugguuaucccccccaaugguuauuuuagauuugauuccugggucaaccaguucuacacacuugcccccaugggaaaugggacggggcguagacgugcauuauaa

SEQ ID NO: 6447 - RNA, 1623 nt, Artificial Sequence
  major_capsid_protein__Norovirus__ADV37917
augaagauggcgucgagugacaccaaaacaucugauggguccacagccaaccucgucccagaggucaacaaugagguuauggcuuuggagcccguuguuggugccgccauugcggcgccuguagcgggccaacaaaauguaauugaccccuggauuagaaauaauuuuguacaagccccugguggagaguucacaguauccccuaggaacgcuccaggugaaauacuguggagcgcgccccuaggcccugauuugaauccuuaccuuucccauuuggccagaauguacaacggcuaugccggcgguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuuuacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgauugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuugcuccaaaacuggguagaguucaauuugccacugacacagacaaugauuuugaugcuaaccaaaacacaaaguucaccccagucggugucauccaggaugguaauacugcccaccgaaaugaaccccaacaaugggugcucccaaguuacucagguagaaauagucacaacgugcaccuggcccccgcuguagcccccacuuuuccgggugagcaacuucucuucuucagaucuacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuuuagauuugauuccugggucaaccaguucuacacacuugcccccaugggaaauggaacggggcguagacgugcauuauaa

SEQ ID NO: 6448 - RNA, 1623 nt, Artificial Sequence
  major_capsid_protein__Norovirus__ADV37919
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuaggaacgcuccaggugaaauacuguggagcgcgccccugggcccugauuugaauccuuaccuuucucauuuggccagaauguacaacggcuaugccggcgguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuuuacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgauugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuugcuccaaaacuggguagaguucaauuugccacugacacagacaaugauuuugaugcuaaccaaaacacaaaguucaccccagucggugucauccaggaugguaauacugcccaccgaaaugaaccccaacaaugggugcucccaaguuacucagguagaaauagucacaacgugcaccuggcccccgcuguagcccccacuuuuccgggugagcaacuucucuucuucagaucuacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuuuagauuugauuccugggucaaccaguucuacacacuugcccccaugggaaauggaacggggcguagacgugcauuauaa

SEQ ID NO: 6449 - RNA, 1608 nt, Artificial Sequence
  major_capsid_protein__Norovirus__AEI83469
augaagauggcgucgaaugacgccgcuccaucuaaugauggugcagccggucucguaccagaggucaacaaugagaccauggcacuugaaccgguggcuggggcuucaauagccgccccacucaccggucaaaauaauguuauagaccccuggauuagauuaaacuuugugcaagcucccaauggagaguuuacaguuucaccccgcaauucgccuggggaaguccuacuaaacuuggaauuagguccugaacuaaauccauauuuggcacaccuuuccagaauguacaaugguuaugcaggaggaguugaggugcaaguacuacuggcugggaacgcguucacggcuggaaaacugguauucgccgcaguccccccgcauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaaccgaggaugaggcuuguggcaaugcucuauaccccccuuaggucuaaugguucuggugaugauguauuuacugucuccuguagagugcuuacucgacccucuccugauuuugauuucaauuauuugguacccccuacaguugaaucuaaaacuaaacccuucacacuccccaucuugaccauaggggaguuaaccaauuccagauucccugugccuauagaugaacucuacacuagccccaaugagaguuuggugguacaaccccagaacgggagaugcgcguuggauggggaguugcagggcacuacucagcuccuccccacggcgaucugcucguucaggggucggauuaaucagaaagugaguggagagaaccauguuuggaauaugcaagucacuaacauuaacggaaccccuuuugauccaacagaggauguuccagcuccucuagguacaccagacuuuucuggcaagcucuuuggcguccuaagccagagggaccaugauaaugccuguaggagccaugaugcagugauugcaacuaauucugcuaaauuuaccccaaaauugggcgcuauacaaauuggcacaugggaagaagaugauguacacaucaaccaacccaccaaauuuacuccaguuggcuuguuugaaagugaagguuuuaaucaguggacacucccuaauuauucuggagccuuaacacucaacaugggguuggcccccccuguggcccccacauuuccuggugagcaaauucuuuucuucagaucccacauuucucuuaaaggagguguggcagacccaguuauugauugucucuugccccaagaguggauccaacaccuuuaucaggagucagccccuucacaaacagauguagcacugaucagauucacaaacccagacacagggcguguccuauuugaagcaaaauugcacaggaguggcuacaucacaguggccaacacugguagcagaccaauuguggugccagcuaaugguuacuucagguuugacucuuggguuaaucaguuuuauucucucgcccccaugggaacugggaaugggcgcagaagggugcaguaa

SEQ ID NO: 6450 - RNA, 1644 nt, Artificial Sequence
  major_capsid_protein__Norovirus__AEP04093
augaagauggcgucuaacgacgcugcuccaucuacggauggaucugccggucucgugccagaggucaauaacgagacuauggcuuuggaaccaguugugggggcuccucucgcugcuccuguagcuggccaacauaauauuauagaccccuggauuaaaaugaauuuugugcaggcacccaauggagaguuuacgguuuccccucggaaugcccccggugaaauuuuguuagacuuggaacuuggcccugaccuuaacccuuaucuuucucaccuggcccgcauguacaacggcuaugcggguggcauggaggugcagguuguuuuagcaggaaaugcuuuuacugccgggaagauuauuuuugcugcuguuccaccuaacuucccagcagagaaccucagugccgcccagguuaccauguguccccaugugauaguugaugucaggcaauuggaaccagucaugcuccccaugccugauauuaggaacaaacuauuucauuacaaccaaguugaugauccaaagcuuagauuguuggcuuaccuuuacacaccccuucgagccaacaaugcuggagaugauguuuucacgguuucuugccggguucuuacuaggccaacuccugauuuugaguuuauguuuuugguuccccccacuguugaaucuaaaacuaagccuuuuucuuuaccuagucuuacccuugaugaacuuuccaauuccagguuuccugcgccuauagugcagcuuuacacaaacccucaugacaaccugguugugcaaccccaaaaugggaggugcacuauagauggccucuugcagggcaccacacaacucguguccuguaauguuugcaguuuuagagggaccaucggugauggacagccggcaagccacagugaggaggagaucaugcccauggccuucaacauccaacgugagcucaugcuagaaaaccuugauggcucacccuaugacccaacugaugacauccccgcagugcugggcuccccugacuuucagggugucauauuuggcauccucagucagaggaauggugaugggcaaaccagggcacaugaggccaagguggacaccagggcggcccgcuucgccccuaaacuuggcuuuguuguggccacuguggagagcacagacuuccacgccaaucagccuagcagauucaccccuguuggguuagguggggauggcaaucaggacuuugcucaguggaaucuaccaaccuacgguggcgcgcugacgaacaacaccaaccucgccccacccgugaugcccguuuacccaggggagcaacuccuauucuuccgcucccagcuaccgagcucugguggugugguuggcggguggcuggauugccugcucccucaggaguggguucaacacuucuuccaggagucggccaccucucaaagcgauguggcccuagucagguauauaaaccccaccacgggcagggugcuuuuugaggcaaaguugcauaaacagggcuuucucacuguggccgccucggguucuuaccccuugguuguucccgccgaugguuauuucagauuugaguccugggugaaucaguuuuauacuuuagcccccaugggaaaugguagugggcguaggagaacccguuaa

SEQ ID NO: 6451 - RNA, 1620 nt, Artificial Sequence
  major_capsid_protein__Norovirus__AEQ77282
augaugauggcgucuaaggacgcccccucaaacauggauggcacuaguggugccggucagcugguuccagagguuaaugcagcugaaccccuaccccuugaaccgguagugggcgccgcaacugcggcagccacugcuggacaagucaauuuaauagaccccuggauuaugaauaauuuuguccaagccccugagggcgaauuuaccauuucacccaauaauaccccuggagacauuuuguuugaucugcauuugggaccacaucuuaauccuuuccuacaacauuuaucacaaauguauaaugguuggguggggaacaugagagucagaguuaugcuagcggggaacgcguucacugcugguaaaaucauaauuuguugugucccaccagguuuugcuucccaaaacauaucaauuggacaagcuacgauguucccccauguaauagcagaugugaggguauuggagccaauugaaaucccccuugaugauguacgcaauguuuuguuucauaccaaugagaaucgccccaccaugcgguuacucugcaugcuguacacaccccuccgugcuggaggagcuucaucaggcacagauccuuuugucaucgcaggucgugugcuaacuugcccuucucccgauuucaacuuccuguuucucgugccuccuaguguggagcagaaaaccaggcaacuaacugugcccaauauacccuugaacaauuuggcuaacuccagagugccugcaaugauaaauaaaaugacaguuucuacugaccaaaaucagguaguccaguuccaaaauggccguugcacacucgaagggcaacuuuugggcacaaccccugucucagcuagucaaguggcccgcauacguggcaaaguuuucuccacugcaucaggaaaaggacucaaccuaacugaguuagauggaaccccuuaccaugcauuugagaguccagccccccuuggcuucccugauauaggagccugugauuggcaugugucaacuuuuaaaguggaucaaaaucuuucgggggaucccauguccagauuagauguaaagcaaaaugccccauuugcaccacaccuaggcucuauugaauucacuucugaccaagacccaacuggggaccaauuagguacacuagccugggucucucccuccaccaguggagcuaggguugacccauggaagaucccaucauauggcucaacagugacugaguccacccaucuggcaccaccuauuuuuccaccagguuuuggugaagcuauagucuauuuuaugucagauuuuccuauugugucaggcaacacugcucaaguucccugcacucuaccccaggaguuuguuucacacuuuguggaacaacaggcaccaguccgaggugaagccgcccuauuacauuauguggacccagauacccaccguaauuugggagaguuuaaauuauacccugauggguucaucaccugugugccaaauacaggugguggcccccaaaaucuuccuacaaaugggguuuuugucuuuucuucuuggguuucuagauauuaucaacuaaagccugugggaacagccgguccggcuaggaggcuuggugugaggagaguauaa

SEQ ID NO: 6452 - RNA, 1608 nt, Artificial Sequence
  major_capsid_protein__Norovirus__AFA55174
augaagauggcgucgaaugacgccgcuccaucuaaugauggugcagccggucucguaccagaggucaacaacgagacgauggcacuugagccgguggcuggggcuuccauagcugccccucuaaccggccaaaauaaugugauagaccccuggauuagaaugaauuuuguccaagcuccaaauggugaauuuacaguguccccccguaauuccccaggugaaguguuguuaaauuuggaauuaggcccugaauuaaauccauuccuggcacaccuuucaagaauguacaaugguuaugcuggugggguugaagugcaggugcuacuugcugggaaugcguucacagcaggaaaacuaguguuugcagcaauccccccacacuucccucuugagaaccugaguccuggucaaauuacaauguucccucauguaauuauugauguuagaacuuuagaaccuguccucuugccuuuaccagauguuagaaauaauuucuuucauuacaaucagcagccugagccccguaugagacuuguggcuauguuguauacuccucuuagaucuaaugguucuggugaugauguguucacagucucuuguaggguccucacucgccccucuccagacuuugauuuuaauuauuugguccccccaacuguggaaucuaaaaccaaaccauucacccugccaauauugaccaucggagaauugucaaauucuagguucccaguaccaauagaugaauuguacaccagcccuaaugaaggagugguugugcaaccucaaaauggcagaucaacacucgauggugaacugcuuggcaccacacaacuuguaccaucaaacaucugugccuugcgagggcgcaucaacgcccaagugccagacgaucaccaucaauggaacuugcagguuacaaaugcaaauggaacuuccuuugaucccacugaagaugucccugcaccauugggcacgccggauuuccuggcaaacaucuacggagucacuagucagaggaacccugacaacacuugccgugcccaugaugggguuuuggcaaccuggagcccuaaauuuacacccaaguuaggaucuguagucuuggguacuugggaagaaagugaucuugaucucaaucagccuaccagauuuacaccuguugguuuguaugauacaggccacuuugaucaguggguucuacccaacuauucuggaagauugaccuuaaacaugaauuuggcgcccucuguugcuccccucuucccaggugaacaaauacucuucuuuaggucccacauaccacuuaaaggaggcacuuccaacggugccauugacugucuacucccucaggaguggauccagcauuucuaucaggagucagccccgucacccacagauguugcccugauuagguacaccaacccugacacgggccguguccuuuuugaggccaaacuacauagacagggauucaucacaguagcaaauucugguucuagaccuauugucgucccuccuaaugguuauuuuagguuugauucuuggguuaaucaguuuuauucucuugcccccaugggaacugggaaugggcguagaagggugcaguaa

SEQ ID NO: 6453 - RNA, 1629 nt, Artificial Sequence
  major_capsid_protein__Norovirus__AFC89656
augaagauggcgucgaaugacgccgcuccaucaaaugauggugcagcuagucucguaccagaggccauuaaugagacuaugccauuggaacccguugcuggcgcaucuauugcugccccaguggcgggacaaacuaauauaauugaccccuggauaagaacaaauuuugugcaagcccccaauggagaguuuacagugucaccaagaaauuccccuggagagauuuuauuaaauuuagaguugggaccagauuuaaauccuuauuuggcccauuuaucaagaauguauaaugguuaugcuggagguguugaggugcaagugcuccuugcugggaacgcguucacagcaggcaagauacuauuugcagcaaucccacccaacuuuccuguagacaugauuaguccagcucaaauuacuaugcuuccccacuugauuguagauguuaggacuuuggaaccuauuaugauacccuuaccugauguuaggaauguguuuuaucauuuuaauaaucaaccucaaccuaggaugagauuaguggcuaugcucuacaccccauugagauccaaugguucaggagaugaugucuuuacugugucuuguagagugcugacuaggccaaccccugacuuugaauuuauuuaccuagugccucccucuguagaguccaaaacuaaaccauucacacuuccaauacugaccauuucugaacuaaccaacucccgguuucccaucucaauugagcaacuguacacggccccaaacgagaacaauguuguacagugucagaauggcaggugcaccuuggauggagagcuucagggcaccacccagcuguuaucaagugcaguuugcucguacaggggcaggacuguggccaacaguggggacaauugggaccagaaugugcuccagcugaccuacccaaguggugcaagcuaugaccccacugaugaaguaccagcacccuugggcacccaggacuucagugggauauuguaugggguguugacccaagacaaugugagagagaauacaggggaggccaaaaaugcuaagggaguauacauaucuaccaccaguggaaaauucaccccaaaaauuggaucaauuggauugcacucaauaacugaagaugugcgccccaaucaacaaucacgguucacccccguuggagucgcccagaaugagaacacccccuuccagcaauggguucuaccacacuacgcaggugcucuugcgcuaaacaccaauuuggcacccgcuguugccccgacuuucccuggcgagcaauugcuguucuucaggucccguguuccauguguucaaggcuugcaggggcaggaugcuuucauagauugucuccugccucaagaaugggugaaucacuuuuaucaagaggcugcuccuucccaagcagacguugcccuuaucagguaugucaacccugacacuggucgcacgcuguuugaggccaaauugcacaggucagguuuuaucacugugucacacacuggugccuacccucuuguggucccuccaaauggucauuucagguuugacucuuggguuaaccaauucuacucacucgcccccaugggaacuggcaaugggcguagaagaguucaauaa

SEQ ID NO: 6454 - RNA, 1617 nt, Artificial Sequence
  major_capsid_protein__Norovirus__AFC89659
augaugauggcgucuaaggacgcccccucaaacauggauggcaccaguggugccggucagcuaguuccagagguuaauacagcugaaccucuaccccuugaaccgguggugggcgccgcaacugcggcggccacugcuggacagguuaauuuaauagaccccuggaucaugaauaauuuuguccaagccccugaaggcgaguucacuauuucacccaacaauacccccggagauauuuuauuugauuugcgucuggggccacaccuuaaccccuuccuccuacauuugucccagauguauaaugguuggguugggaacaugagaauuagggucaugcuugcagggaacgcguucucugcugguaagaucauaauuuguugugucccaccuggcuuugaaucccagaacauaucaauuggacaagccacuauguucccccaugucauagcugauguaagaguccuggagcccauagagaucccccuugaugaugugcgcaauguccuguaccacacaaaugagaaccgcccaaccaugcgauugcucugcauguuauacacaccucuccgugcuggaggagcuucaucaggcacagacccuuuugucauugcuggccguguguuaacuugcccugccccugacuuuaauuuucuguuucuugugccccccaguguagaacagaaaaccaggcaauugacuauacccaauauacccuugaacaauuuggcuaacuccagagugccugcaaugauaaacaagauggcagucucugcugaucagaaucaggugguccaguuucaaaauggccguugcacacuugaaggacaacucuuagguacaacuccuguuucagccaaccaaguugcccgcauacguggcaaagucuucuccaccaacuccgggacgggacuuaauuuaacugaaacagauggaacccccuaccaugcauuugagagcccggccccucucgguuuuccugauauaggugauugugauuggcauguguaugcuuuuaaggugaaucaaaacacaggggaucccauguacagauuggauauaacacaaggaaacucauuugcgccgcaucuuggcuccaucgaguuuacuucugaucagcacccaucaggagaucaauuaggcacacuuacuuggaucuccccucucaacaaugccuccaggguugaucccuggaaaaucccaucauaugguucaacauugacugaguccacuaaccuggcaccacccaucuuuccaccaggcuuuggugaggccauagucuacuucaugucagauuucccuauugugucagguaacacuacccaaauccccuguacccugccccaagaguucaucucauccuuuguggaacaacaggcaccaauccgaggugaggcugcucuacugcauuauguggacccagauacccaucgcaaucugggagaauucaaacuguacccugauggguucaucacuugugugccaaacacggguggcggcccccaaaaccucccuucaaaugguguuuuuaucuuuucuucuugggucucuagauauuaucaauugaagccugugggaacagccgguccggcuaggcggcuuggugugagaaggauauaa

SEQ ID NO: 6455 - RNA, 1647 nt, Artificial Sequence
  major_capsid_protein__Norovirus__AFC89662
augaagauggcgucgaaugacgccacuccaucuaaugauggugccgccggccucgucccagagaucaacaaugaggcaauggcgcuagauccaguggcgggugcagcgauagcagcaccucucacuggucagcaaaauauaauugaucccuggauuaugaauaauuuugugcaagcaccugguggugaguuuacaguauccccuaggaauuccccuggugaagugcuucuuaauuuggaauugggcccagaaauaaaucccuauuuggcccaucuugcuagaauguauaaugguuaugcagguggauuugaagugcagguaguccuagcuggaaaugcguuuacagcaggaaagauaaucuuugcagcuauaccccccaauuuuccaacugauaaucuaagcgcagcacagaucacaaugugcccacaugugauuguggaugucagacaguuggaaccagucaaccucccgaugccugacguucgcaacaacuucuuccauuacaaucaagggucugauucgagauugcgcuuaauugcaaugcuguauacaccucuuagggcaaauaauucuggugaugauguuuuuacugugucuuguagagugcugacuaggccuagcccugacuucucauuuaauuuccuugugccaccuacuguggagucaaagacaaaacccuucacucucccuauucugacuaucucugaaauguccaauucuagguuuccagugccgauugauucucugcacaccagcccaacugagaauauuguuguccagugccaaaaugggcgcgucacucuugauggugaguugaugggcaccacccaacucuuacccagucaaaucugugcuuucaggggcgugcucaccaggucaacaagcagggccagugaccaggccgacacagcaaccccuagguuguuuaauuauuauuggcacauacaauuggauaaucuaaauggaacucccuaugauccugcagaagacauaccaggcccccuagggacgccagauuuucggggcaaaaucuuuggcguggccagccagagaaacccugacagcacaacuagagcacaugaagcaaagguggacacaacagcuggucguuucaccccaaaacuaggcucauuagagauauccacugaaucuggugacuuugaccaaaaccaaccaacaagauucaccccaguuggcauugggguugacaaugaagcggacuuucaacaauggucuuuacccgacuauucuggucaguucacccacaacaugaacuuagccccagcuguugcucccaacuucccuggugagcagcuccucuucuuccgcucacaguuaccauccucuggugggcgauccaacgggauucuagacugccuggucccccaagaguggguucagcacuucuaccaagaaucggcccccgcucaaacucaaguggcccugguuagguaugucaacccugacacugguagaguauuauuugaggccaagcugcacaaauuagguuucaugacuauagcuaagaauggugauucuccaauaacugucccuccaaauggauacuuuagguuugaaucuugggugaacccauuuuauacacuugcccccaugggaacugggaaugggcguagaaggauucaauaa

SEQ ID NO: 6456 - RNA, 1620 nt, Artificial Sequence
  major_capsid_protein__Norovirus__AFC89665
augaagauggcgucgaaugacgccgcuccaucuaaugauggugcuacaggucucguaccagagaucaacacugagaccuugccucucgagcccguggccggagcggcaauugcugccccuguuacgggccaaaauaauauaauugaucccuggauuagaaauaauuuugugcaggcgccuaauggugaguuuacaguuuccccuagaaauuccccuggugaaauuuuaaugaauuuggaguuagggccagaucuuaauccauauuuggcucaccuuucaagaauguacaaugguuaugcuggagguguagaagugcaagugcuccuagcugggaaugcguucacggcaggaaagauccuuuuugcagcaguccccccaaauuuccccguugauaugcucaguccugcucaaaucacaaugcuuccccauuuaauuguagauguuagaacuuuggagcccauuaugaucccucugcccgauguuaggaauguuuucuaucacuuuaauaaccagccugccccaagaaugagauugguugccaugcucuacaccccuuuaagauccaauggguccggugaugacguauucaccgucuccugcagggugcuaacuagaccuacuccggacuuugaguuuacauacuuagucccccccucgguagaguccaaaaccaaaccuuucacccuacccauccuaacaauuggagaguugacaaacucuagauuuccagccccgaucgaucaguuguacacuucacccaacgcugauguaguuguccaaccccaaaauggccggugcacacuggauggugagcuacaagguacaacacaacuuuugacaacagcaauaugcucauacaggggcaugacaucaaaccccacuagugacuacugggaugaucaccuccugcaccugguccaccccaauggggcaacauaugacccgaccgaggacgugccagcuccuuuuggcacgcaggacuuucggggcauucuguaugggauguugacucaaaacccccgaaccuccggggacgaagccgccaacucccaugggaucuacaucucauccaccagugaaaaguucacuccaaaauuggguacaauuggcuuacaccaagugcaaggcgacauagccagcaaccaacagucaaaauucacaccaguagggauagcagugaauggcaacacuccuuucaggcagugggaacucccaaacuacucuggugcucucacccucaacacaaaccuugcaccagcgguugggcccaacuucccuggggagcaaauccuuuucuucaggucaaauguuccaaguguucaagguggccaaccuauagagauugauugccugaucccacaagaaugggucucccauuucuaucaagaaucagcccccucucagagugauguggccuuggucagguaugucaacccugacacagggcgcacaaucuuugaggccaaauugcauaggcagggauuuaucaccauagcggccacuggaagcaaccccguggucgugccucccaauggguauuucagauuugauuccugggucaaccaguuuuaugcacucgcccccaugggaacugggaaugggcgcagaagaguucaguaa

SEQ ID NO: 6457 - RNA, 1623 nt, Artificial Sequence
  major_capsid_protein__Norovirus__AFC89667
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucaccauguucccccacauaauaguagauguuaggcaauuggaaccuguguugauccccuuaccugauguuaggaauaacuucuaccacuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccaguaggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucggauguggcucuauugagauuugugaauccagacacggguaggguccuguuugagugcaaacuucauaaaucaggcuaugucacaguggcucacaccggccagcaugauuuggucaucccccccaacggcuauuuuagguuugauuccuggguuaaucaauucuacacacuugcccccaugggaaauggaacggggcguagacgugcuuuauaa

SEQ ID NO: 6458 - RNA, 1626 nt, Artificial Sequence
  major_capsid_protein__Norovirus__AFD62272
augaggaugagugauggcgcagcgccaaaagccaacggcucugaagccagcggccaggaucuuguuccuaccgccguugaacaggccguccccauucagcccguggcuggcgcggcucuugccgcccccgccgccgggcaaaucaaccagauugacccauggaucuuccaaaauuuuguccaaugcccccuuggugaguuuuccauuucaccccgaaacaccccaggugaaauacuguuugauuuggcccucggaccggggcucaaccccuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacuuccccuucuugacgugcgucgaguucuuuggcaugcuacccaggaucaggaggaaucuaugcgccugguuugcauguuguacacgccacuccgcacaaacagcccgggugaugagucuuuuguggucucuggccgccuucuuucuaagccggcggcugauuucaacuuuguauaccugaccccccccaucgagaggaccaucuaccgaauggucgaccugcccguguugcagccgcggcugugcacgcacgcucguuggccagccccggucuauggccucuugguugacccgucccucccguccaacccccaauggcagaauggaagagugcacguugauggaacccuucuuggcacaacaccugucucugguuccuggguuuccugcuuugcagcagaagccgccuacgaguuccagucugggacuggucagguggcgaccuucaccaugauugagcaggacgggucugccuacgucccuggugacagggcggccccccuuggcuaccccgauuacuccgggcaacuggagauugaggugcagacugagaccaccaaagcaggugacaagcugaaagugaccaccuuugagaugauccuuggucccacuaccaacguggaccaggcucccuaccaggguagagcguaugcgagcuuaacggcugcagccucacucgaccugguagacgggaggguuagggcggucccccgcucuaucuacuccuuccaggacgugcucccagaguacaaugauggucuuuuggucccccuugccccaccccugggucccuuccuucccggugaggucuuguugagguuccgaaccuacaugcgccagcuugacaccgcugacgccgcggcgcagccgauugacugugccuugccccaggaguucgucucuugguucgcaagcaacagcuucacgguccagucggacgcgcuccugguuagguaccggaacaccuugaccggccagcuccuguucgaggcuaagcucuauagugaaggcuacauugcugugucuuauucaggaucuggcccccucacuuuucccgccgacggcuucuucgaggucguuaguugggucccccgccucuuucaauuggccucugugggaagcuuggcaacaggccgaacacucaaacaauaa

SEQ ID NO: 6459 - RNA, 1620 nt, Artificial Sequence
  major_capsid_protein__Norovirus__AFJ04707
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguguccccuagaaacgcuccgggugagauacuauggagcgcgcccuugggcccugauuugaaccccuaccuuucucauuuagccagaauguacaaugguuaugcaggugguuuugaagugcagguaauccuugcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaugacgucuucacagucucuugucgaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguacacgggucccagcagugcuuuuguuguccaaccacaaaauggcaggugcacgacugauggcgugcucuugggcaccacccagcugucugcugucaacaucugcaccuucagaggggauaucacucacauugcaggcagucaugacuauacaaugaaucuggcuucucaaaauuggagcaauuaugacccaacagaagaaaucccagccccucugggaacuccagacuucgugggaaagauccaaggcaugcucacccaaaccacaagagaggauggcucgacccgcgcccacaaagccacagugagcacugggaguguccacuuuacuccaaagcugggcaguguucaauacaccacugacacaaacaaugauuuucaaacuggccaaaacacaaaauucaccccagucggcgucauccaggacggugguaaccaucaaaaugaaccccaacaauggguacucccaaauuauucagguagaacuggucauaaugugcaccuagcuccugccguugcccccacuuucccgggugaacaacuucucuucuuuagguccacuaugcccgggugcagcggguaucccaacaugaaucuggauugccuacuuccccaggaaugggugcaacacuucuaucaagaagcagccccagcacaaucugauguggcccugcugagauuugugaauccagacacagguaggguuuuguuugagugcaaacuucauaaaucaggcuauguuacaguggcucacacugguccgcaugaucugguuaucccccccaaugguuacuucagauuugauuccugggucaaccaguucuacacacuugcccccaugggaaauggagcggggcguagacgugcauuauaa

SEQ ID NO: 6460 - RNA, 1623 nt, Artificial Sequence
  major_capsid_protein__Norovirus__AFJ04708
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuugugcaagccccugguggagaauuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuacccgauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauucuaacuguugaggaaaugaccaauucaagauucccuauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccauaaagcuacagugagcacuggggauguccacuucacuccaaagcugggcaguauucaguucaacacugauacaaacaaugauuuugaaacuggccaaaacacgaaauucaccccagucgguguuguccaggaugguaauggugcccaccaaaaugaaccucaacaaugggugcucccaagcuacucagguagaacuggucauaauguacaccuagcccccgccguagcccccacuuuuccgggugagcaacuucuuuucuuuagguccacuaugcccggaugcagcggguaccccaacaugaauuuggauugucuacucccccaggaaugggugcagcacuucuaccaagaggcagcuccagcacaaucugauguggcucugcuaagauuugugaauccagacacaggucggguucuauuugagugcaagcuucauaaaucaggcuaugucacaguggcucacacuggccaacaugauuugguuaucccccccaauggcuacuuuagauuugauuccugggucaaccaauucuacacacuugcccccaugggaaaugggacggggcguagacgugcauuauaa

SEQ ID NO: 6461 - RNA, 1623 nt, Artificial Sequence
  major_capsid_protein__Norovirus__AFJ04709
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucaccauguucccccacauaauaguagauguuaggcaauuggaaccuguguugauccccuuaccugauguuaggaauaacuucuaccacuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccaguaggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucggauguggcucuauugagauuugugaauccagacacggguaggguccuguuugagugcaaacuucauaaaucaggcuaugucacaguggcucacaccggccagcaugauuuggucaucccccccaacggcuauuuuagguuugauuccuggguuaaucaauucuacacacuugcccccaugggaaauggaacgggggguagacgugcauuauaa

SEQ ID NO: 6462 - RNA, 1623 nt, Artificial Sequence
  major_capsid_protein__Norovirus__AFP89593
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccaggauguacaauagcuaugcagguggcuuugaagugcagguaauccuugcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacggucucuugucgaguccucacgaggccaucccccgauuuugauuucauauucuuggugccacccacaguugagucaagaacuaaaccauucaccgucccaauuuuaacuguugaagaaaugaccaauucaagauucccuauuccuuuggaaaaguuguucacgggcccuagcggugccuuuguuguucaaccacaaaauggcaggugcacgacugauggcguacucuuaggcacuacccaacugucuccugucaacauuugcaccuucagaggggaugucacccacauugcaggcacucauaauuacacaaugaauuuggcuucucaaaauuggaacaauuaugacccaacagaagaaaucccagccccucuggggaccccagacuucgugggaaggauccaaggcaugcucacccaaaccacaaggggagauggcuccacccgcggccacaaagcuacagugagcacuggggauguccacuucacuccaaagcuggguaguauucaauucaacacugauacaaacaaugauuuugaaacuggccaaaacacgaaauucaccccagucgguguuauccaggauggcaaugguacccaccaaaaugaaccucaacaaugggugcucccaaguuacucagguagaacuggucauaauguacaccuagcccccgccguagcccccacuuuuccgggugagcagcuucuuuucuucagguccacuaugcccggaugcagcggguaccccaacaugaaucuggauugccuacucccccaagaaugggugcagcacuucuaucaagaggcagcuccagcacaaucugauguggcucugcuaagauuugugaauccagacacagguaggguucuauuugagugcaagcuccauaaaucaggcuacgucacaguugcucacacuggccagcaugauuugguuaucccccccaauggcuacuuuagauuugauuccugggucaaccaauucuacacacuugcccccaugggaaaugggacggggcgcagacguguauuauaa

SEQ ID NO: 6463 - RNA, 1623 nt, Artificial Sequence
  major_capsid_protein__Norovirus__AFU55686
augaagauggcgucgaaugacgccaacccaucugauggguccacagccaaccucgucccagaggucaacaaugagguuauggcuuuggagcccguuguuggugccgcuauugcggcaccuguggcgggccaacaaaauguaauugaccccuggauuagaaauaauuuuguacaggccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccagucaaaugaccccaccauuaaauugauagcaaugcuguacacaccacuuagggcuaauaaugcuggggaagaugucuucacagucucuugucgaguccucacgaggccauccccugauuuugauuuuauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcaccacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcugggcaguauucaauucaacacugauacaaacaaugauuuugaagcuggccaaaacacgaaauucaccccagacgguguuguccaggaugguaaugguacccaccaaaaugaaccccaacaaugggugcucccaagcuacucagguagaacuggucauaauguacaccuagcccccgccauagcccccacuuuuccgggugagcaacuucuuuucuucagguccacuaugcccggaugcagcggguaccccaacaugaauuuggauugucuacucccccaagaaugggugcagcacuucuaccaagaggcggcuccagcacaaucugauguggcucugcuaagauuugugaauccagacacggguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacgugcauuauaa

SEQ ID NO: 6464 - RNA, 1623 nt, Artificial Sequence
  major_capsid_protein__Norovirus__AFU55689
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuucuaucauuauaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauuccccauuccuuuggaaaaguuguucacgggucccagcagugccuuuguuguucaaccacaaaauggcagaugcacgacugauggcgugcucuuaggcaccacucaacugucuccuguuaacaucugcaccuucagaggggaugucacccacauugcagguacucaaaacuacacaaugaaucuggccucccaaaauuggaacaauuaugacccaacagaagaaaucccagccccucugggagccccagauuuuguaggaaagauccaaggcgugcucacccaaaccacaaggggggauggcucgacccgcggucacaaagccacagugagcacuggaaguguccacuuuaccccaaagcugggcaguguucaauucucuacugauacaagcaaugaccuugaaacuggccaaaacacgagguucaccccagucggugucguccaggaugguaguaccacccaccaaaaugaaccccaacaaugggugcucccaaacuauucagguagagauagucacaauguacacuuagccccugccguggcccccacuuuuccgggugagcaacuucuuuucuuuagguccacuaugcccggaugcagcggguaucccaacaugaauuuggauugccuacucccccaggagugggugcagcacuucuaucaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaaugguuauuuuagauuugauuccugggucaaccaauucuacacacuugcccccaugggaaauggagcggggcguagacgugcauuauaa

SEQ ID NO: 6465 - RNA, 1623 nt, Artificial Sequence
  major_capsid_protein__Norovirus__AFU55692
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagguucccuauuccuuuggaaaaguuguucacgggucccagcagugccuuuguuguucaaccacaaaauggcagaugcacgacugauggcgugcuuuuaggcaccacccaacugucuccugucaacaucugcaccuucagaggggaugucacccacauugcagguacucaaaauuacacaaugaaucuggccucccagaauuggaacaauuaugacccaacagaagagaucccagcuccucugggaaccccagauuuuguaggaaagauccaaggcgugcucacccaaaccacaaggagggacggcucgacccgcggucacaaagccacaguaagcacuggaaguguccacuucaccccaaagcugggcagcguucaauucucuacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaccaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6466 - RNA, 1623 nt, Artificial Sequence
  major_capsid_protein__Norovirus__AFU55695
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguaucuccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuauauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuagguaccacccaacugucuccugucaacaucugcaccuucagaggggaugucacccacauugcagguucucgcaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaauacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggaaugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6467 - RNA, 1623 nt, Artificial Sequence
  major_capsid_protein__Norovirus__AFU55698
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuauaaccaaucaaaugaccccaccaucaaauugauagcaauguuguauacaccacuaggggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguaccacccaacugucuccugucaacaucugcaccuucagaggggaugucacccacauugcugguacucaagaauacacaaugaaucuggccucccaaaacuggaacaauuaugacccaacagaagaaaucccagccccucuggggacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggucaacaugauuuaguuaucccccccaauggcuauuuuagauuugauuccugggucaaccaguucuacacacuugcccccaugggaaauggaacggggcguagacgugcauuauaa

SEQ ID NO: 6468 - RNA, 1623 nt, Artificial Sequence
  major_capsid_protein__Norovirus__AFU55701
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuauaaccaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcugguacucaagaauacacaaugaaucuggccucccaaaacuggaacaauuaugacccaacagaagaaaucccagccccucuggggacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuacacacuugcccccaugggaaauggaacggggcguagacgugcauuauaa

SEQ ID NO: 6469 - RNA, 1623 nt, Artificial Sequence
  major_capsid_protein__Norovirus__AFU55704
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacagucuacacugggagugcccccuuuacuccaaagcugggcaguguucaauucaguacugauacagaaaaugauuuugaaacucaccaaaauacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuguaa

SEQ ID NO: 6470 - RNA, 1623 nt, Artificial Sequence
  major_capsid_protein__Norovirus__AFU55707
augaagauggcgucgaaugacgccaacccauccgauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagugcgcccuuaggcccugauuugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuacuauuaaauugauagcaaugcuguauacaccacuuagggcuaauaaugcuggggaagaugucuucacagucucuugucggguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucguggggaagauccaaggugugcucacucaaaccacagagggagauggcucgacccguggccauaaagcuacaguuuacacugggagugccccuuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6471 - RNA, 1623 nt, Artificial Sequence
  major_capsid_protein__Norovirus__AFU55710
augaagauggcgucgaaugacgccaacccaucugauggguccgcagccaaccucgucccagaggucaacaaugagguuauggcuuuggagcccguuguuggugccgccauugcggcgccuguagcgggccaacaaaauguaauugaccccuggauuagaaauaauuuugugcaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaugaugucuucacagucucuugucgaguccucacgaggccauccccugauuuugacuuuauauuccuggugccaccuacaguugagucaagaacuaagccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacauuugcaccuucagaggggacgucacccacauugcggguucucguaauuacacaaugaauuuggccucucuaaauuggaacaauuaugacccaacagaggaaauuccagccccucugggaacuccagauuucgugggaaagauccaaggugugcucacucaaaccacaaagggagauggcucgacccggggccauaaagcuacaguuuacacugggagugccgacuucacuccaaagcugggcaguguucaauuugcuacugauacagaaaaugauuuugaaacucaccaaaacacaaaauucaccccagucggugucauccaggaugguagcaccacccaucgaaaugaaccccaacaaugggugcucccaaguuauucagguagaaauguccauaauguacaccuagccccugcuguagcccccaauuuuccgggugaacaacuucuuuucuucagguccacuaugcccggaugcagcggauaucccaacauggauuuggauugucuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccaacaugauuuggucaucccccccaauggcuauuuuagguuugauuccuggguuaaucaauucuauacacuugcccccaugggaaauggaacggggcguagacgugcuuuauaa

SEQ ID NO: 6472 - RNA, 1623 nt, Artificial Sequence
  major_capsid_protein__Norovirus__AFU55713
augaagauggcgucgaaugacgccaccccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgccccuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagaugucaggcaacuggaaccuguguugauucccuuacccgauguuaggaauaauuucuaucacuacaaucaaucaaacgaccccaccaucaaauugauagcaauguuguacacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauccaaggugugcucacccaaaccacaagggcagauggcucuacccgcggccacaaagcuacaguguacacugggagcgccgauuuugcuccaaaacuggguagaguucaauuugccacugacacagauaaugauuuugaugcuaaccaaaacacaaaguucaccccagucggugucauccaggauggugauacugcccaccgaaaugaaccccaacaauggguacucccaaguuacucaggcagaaauagucacaaugugcaccuggcccccgcuguagcccccacuuuuccgggugagcaacuucucuucuucagaucuacuaugcccggaugcagcggguaccccaacauggauuuggacugucugcucccccaggaaugggugcaguacuucuaucaagaggcagccccagcacaaucugauguggcucugcuaagauuugugaauccagacacagguaggguuuuguuugaguguaagcuucauaaaucaggcuauguuacaguggcucacaccggccaacaugacuugguuaucccccccaaugguuauuuuagauuugauuccugggucaaccaguucuacacacuugcccccaugggaaauggaacggggcguagacgugcauuauaa

SEQ ID NO: 6473 - RNA, 1623 nt, Artificial Sequence
  major_capsid_protein__Norovirus__AFU55716
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaggugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaagaugucuucacagucucuugccgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuauucacgggucccagcagcgccuuuguuguucaaccacaaaauggcagaugcacgacugauggcgugcucuuaggcaccacccaacugucuccugucaacaucugcaccuucagaggggaugucacccacauugcagguucucguaauuacacgaugaauuuggcuucucuaaauuggaacaauuaugacccaacagaagaaauuccagccccucuaggaacuccagauuucgugggaaagauccaaggcgugcucacccaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcauuucuaccaagaggcagcuccagcacaaucugauguggcucuauugagauucguaaauccagacacggguaggguccuguuugagugcaagcuucauaaaucaggcuaugucacaguggcucacaccggccagcaugauuugauuaucccccccaaugguuauuuuagguuugauuccuggguuaaucaauucuacacacuugcccccaugggaaauggaacggggcguagacgugcuuuauaa

SEQ ID NO: 6474 - RNA, 1623 nt, Artificial Sequence
  major_capsid_protein__Norovirus__AFU55719
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguuuccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucauuauaaucagucaaaugauucuaccauuaaauugauagcaauguuguauacaccacuuagggccaauaaugccggggaugaugucuucacagucucuugucgaguccucacgaggccauccccugauuuugauuucauauuuuuggugccaccuacaguugagucaagaacuaagccguuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaauugucuccugucaacaucugcaccuucagaggggaugucacccacauugcggguucucguaauuacacaaugaacuuggccucucuaaauuggaacaauuaugacccaacagaagaaauuccagccccucugggaacuccagauuucgugggaaagauccaaggugugcucacucagaccacaaagggagauggcucgacccggggccauaaagcuacaguuuacacugggagugcugacuuuaccccaaagcugggcaguguucaauuugguacugauacagagaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaauuuuccgggugaacaacuucucuucuucagguccacuaugcccggaugcagcggguaucccaacauggauuuggauugccugcucccccaggaaugggugcagcacuucuaccaagaggcagcuccagcacaaucugauguggcucuauugagauuugugaauccagacacggguaggguccuguuugagugcaaacuucauaaaucaggcuaugucacaguggcucacaccggccaacaugauuugguuaucccccccaauggcuauuuuagguuugauuccuggguuaaucaauucuacacacuugcccccaugggaaauggaacggggcguagacgugcuuuauaa

SEQ ID NO: 6475 - RNA, 1623 nt, Artificial Sequence
  major_capsid_protein__Norovirus__AFU55722
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacucaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucacuccagucggcguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6476 - RNA, 1623 nt, Artificial Sequence
  major_capsid_protein__Norovirus__AFU55725
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaauaacuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaauaauauuuucagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccauaaaauugauagcaauguuguauacaccacuuagggcuaauaaugcuggggacgaugucuucacaguuucuugucgaguucucacgagaccaucccccgauuuugauuucauauuccuagugccacccacaguugaaucaagaacuaaaccauucucugucccaauucuaacuguugaggagaugaccaauucaagguuccccauuccuuuggaaaagcuguucacgggccccaguaguaccuuuguuguucaaccacaaaacggcaggugcacgacugauggcgugcuccuagguaccacccaacugucuccugucaacaucugcaccuucagaggggaugucacccauauuacaggcagucguaacuauacaaugaaucuggcuucccaaaauuggaacaguuaugacccaacagaagagaucccagccccucuagggacuccagauuucguggggaagauucaaggcgugcucacccaaaccacaaggacggauggcucgacccgcggccacaaagcuacaguguacacugggagcgccgaauuuuccccaaaacuggguagaguucaauuugccacugacacagacaaugauuuugaugccaaccaaaacacaaaguucaccccagucgguguuauccaggauggugguacuacccaccgaaaugaaccccaacaaugggugcuuccaaguuacucaggcagaaauacucacaaugugcaccuggcccccgcuguagcccccacuuuuccgggugagcagcuccucuuuuucaggucuaccaugcccggaugcagcggguaccccaacauggauuuggacugucuacucccccaggaaugggugcagcauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6477 - RNA, 1623 nt, Artificial Sequence
  major_capsid_protein__Norovirus__AFU55728
augaagauggcgucgagugacgccaacccaucugauggguccacagccaaccuugucccagaggucaacaaugagguuauggcuuuggagcccguaguuggugccgccauugcggcaccuguggcgggccaacaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaccaaucaaaugaccccaccaucaaauugauagcaauguuguacacaccacuuagggcuaauaaugccggggacgaugucuucacaguuucuugucgaguucucacgaggccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucacaacuacacaaugaauuuggccucccaaaauuggaauaguuacgauccaacagaagaaaucccagccccucuaggaacuccagauuucguggggaagauucaaggugugcucacccaaaccacaaggacaaauggcucgacccgcggccacaaagccacaguguacacugggagcgccgacuuuucuccaaaacuggguagaguucaauuugccacugacacaaacaaugauuuugaaacuaaccaaaacacaaaguucaccccagucgguguuauccaggaugguaguaccaccccccgaaaugaaccccaacaaugggugcucccaaguuauucaggcagaaacacucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagguuugugaauccagacacagguaggguuuuguuugaguguaagcuucauaaaucaggcuauguuacaguggcucacacuggccaacaugauuugguuaucccucccaaugguuauuucagauuugauuccugggucaaccaguucuacacacuugcccccaugggaaaugggacggggcguagacgugcauuauaa

SEQ ID NO: 6478 - RNA, 1623 nt, Artificial Sequence
  major_capsid_protein__Norovirus__AFU55731
augaagauggcgucgagugacgccaacccaucugauggguccacagccaaccuugucccagaggucaacaaugagguuauggcuuuggagcccguaguuggugccgccauugcggcaccuguggcgggccaacaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaccaaucaaaugaccccaccaucaaauugauagcaauguuguacacaccacuuagggcuaauaaugccggggacgaugucuucacaguuucuugucgaguucucacgaggccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucacaacuacacaaugaauuuggccucccaaaauuggaauaguuacgauccaacagaagaagucccagccccucuaggaacuccagauuucguggggaagauucaaggugugcucacccaaaccacaaggacaaaugguucgacccgcggccacaaagccacaguguacacugggagcgccgacuuuucuccaaaacuggguagaguucaauuugccacugacacaaacaaugauuuugaaacuaaccaaaacacaaaguucaccccagucgguguuauccaggaugguaguaccaccccccgaaaugaaccccaacaaugggugcucccaaguuauucaggcagaaacacucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagguuugugaauccagacacagguaggguuuuguuugaguguaagcuucauaaaucaggcuauguuacaguggcucacacuggccaacaugauuugguuaucccucccaaugguuauuucagauuugauuccugggucaaccaguucuacacacuugcccccaugggaaaugggacggggcguagacgugcauuauaa

SEQ ID NO: 6479 - RNA, 1623 nt, Artificial Sequence
  major_capsid_protein__Norovirus__AFU55734
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccggaaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugaccccaccaucaaauugauagcaauguuguacacaccacuuagggcuaacaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguaccacccaacuguccccugucaacaucugcaccuucagaggggaugucacccauauuccaggcagucguaacuacacaaugaauuuggccucccaaaauuggaacaguuacgacccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuuuuaccaagaggcagccccagcacaaucugauguggcucuguuaagauuugugaauccagacacagguaggguuuuguuugaguguaaacuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6480 - RNA, 1623 nt, Artificial Sequence
  major_capsid_protein__Norovirus__AFU55737
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaacggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6481 - RNA, 1623 nt, Artificial Sequence
  major_capsid_protein__Norovirus__AFU92659
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguucacaguauccccuagaaacgcuccaggugaaauauuauggagcgcgcccuugggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaauaauuucuaucauuauaaucaaucaaaugacuccaccaucaaauugauaccaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuaucccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaguuacacaaugaaucuggccucccaaaauuggaacaauuaugacccaacagaagaaaucccagccccucugggaaccccagauuuuguaggaaagauccaaggcgugcucacucaaaccacaaggggggauggcucgacccgcggucacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccaaacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaucaauucuacacacuugcccccaugggaaauggagcggggcguagacgugcauuauaa

SEQ ID NO: 6482 - RNA, 1623 nt, Artificial Sequence
  major_capsid_protein__Norovirus__AFU92660
augaagauggcgucgaaugacgcccacccaucugauggguccacagccaaccucgucccagaggucaacaaugagguuauggcuuuggagcccguuguuggugccgcuauugcagcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucugaaucccuaccuuucucauuuggccagaauguacaauggcuaugcagguggcuuugaagugcagacaauccucgcggggaaugcguucaccgcugggaaaauuauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuauaaccaaucaaaugaccccaccauuaaauugauagcaaugcuguacacaccacuuagggcuaauaaugcuggggaugaugucuucacagucucuugucgaguccucacgaggccaucccccgauuuugauuuuauauuuuuggugccacccacaguugagucaagaacuaaaccauucaccgucccaauuuuaacuguugaggaaaugaccaauucaagauuccccauuccuuuggaaaaguuguucacggguccuagcagugccuuuguuguucaaccacaaaauggcaggugcacgacugauggcgugcucuuaggcacuacccaauugucuccugucaacaucugcaccuucagaggggacgucacccacauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagccacagugagcacuggggauguccacuucaccccaaagcugggcaguauccaguucaacacugauacaaacaaugauuuugaaacuggccaaaacacgaaauucaccccagucgguguuguccaggacgguaauggcacccaccaaaaugagccucaacaaugggugcucccaaguuacucagguagaacuggucauaauguacaccuagccccugccguagcccccacuuuuccgggugagcaacuucuuuucuucagguccacuaugcccggaugcagcggguaccccaacaugaauuuggauugccuacuuccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggucagcaugauuugguuaucccccccaauggcuacuuuagauuugauuccugggucaaccaauucuacacacuugcccccaugggaaaugggacggggcguagacgugcauuauaa

SEQ ID NO: 6483 - RNA, 1623 nt, Artificial Sequence
  major_capsid_protein__Norovirus__AFU92661
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuaugccacgcgcccuugggcccugauuugaaucccuaccuuucccauuuggccagaauguacaaugguuaugcaggugguuuugaagugcagguaauccucgcggggaacgcguucaccgccgggaaaaucauauuugcagcaguuccaccaaauuucccaacugaaggcuugagccccagucaggucacuauguucccccauauaauaguagauguuaggcaacuggaaccuguguugaucccccugccugauguuaggaauaacuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcuuuuagguacuacccaacugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaggauccaaggcgugcucacccaaaccacaaggagggacggcucgacccgcggucacaaagccacauuaagcacuggaaguguccacuucaccccaaagcugggcaguguucaauucucuacugauacaagcaaugacuuugaaacuggccaaaacacgagauucaccccagucggugucguccaggaugguaguaccacccaccaaaaugaaccccaacaaugggugcucccaaacuauucagguagagauagucacaauguacaccuagccccugccguggcccccacuuuuccaggugagcaacuucuuuucuuuagguccacuaugcccggaugcaguggguaucccaacaugaauuuggauugccuacucccccaggagugggugcagcacuucuaccaagagucagccccagcacaaucugauguggcacugcugagauuugugaauccagacacagguaggguuuuguuugagugcaagcuccauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6484 - RNA, 1623 nt, Artificial Sequence
  major_capsid_protein__Norovirus__AFU92662
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggcacgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugaugucaggaacaauuuuuaucauuacaaucaaucaaaugaccccaccaucaaauugauagcaaugcuguauacaccacucagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucagccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguauccacuucaccccaaagcugggcaguguucaauucuccacugauacaagcaaugacuuugaaacuggccaaaacacgagauucaccccagucgguguuguccaggaugguaguaccacccaccaaaaugaaccccaacaaugggugcucccaaacuauucagguagagauagucacaauguacaccuagccccugccguggcccccacuuucccgggugagcaacuucuuuucuuuagguccacuaugcccggaugcagcggguaucccaacaugaauuuggauugccuacucccccaggagugggugcaacacuucuaccaagagucagccccagcacaaucugauguggcacugcugagauuugugaauccagacacugguaggguauuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacgugcauuguaa

SEQ ID NO: 6485 - RNA, 1623 nt, Artificial Sequence
  major_capsid_protein__Norovirus__AFU92663
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguauccccuagaaacgcuccaggugaaauauuguggagcgcgcccuugggcccugauuugaaucccuaccuuucccauuuguccagaauguacaaugguuaugcaggugguuuugaggugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccuuuaccugauguuaggaacaauuucuaccacuacaaucaaucaaaugaccccaccaucaaauugauagcaaugcuguauacaccacuuagggcuaauaaugcuggggacgacgucuucacagucucuugucgaguucucacgagaccauccccugauuuugauuucauauuuuuggugccacccacaguugagucaagaacuaaaccauucucugucccaaucuuaacuguugaggagaugaccaauucaagauucccuaucccuuuggaaaaguuguucacgggucccagcagugccuuuguuguucaaccacaaaauggcaggugcacgacugauggcgugcucuuagguacuacccaacuguccccugucaacaucugcaccuucagggggaaugucaccaacauugcagguucucaaacuuacacaaugaaucuggccucccaaaauuggaacaauuaugacccaacagaagaaaucccagccccucuggguacuccagauuuuguaggaaggauccaaggcgugcucacccaaaccacaaggggggauggcucgacccgcggucacaaagccacagugagcacuggaagugccuacuuuaccccaaagcugggcaguguucaauucuccacugauacaagcacugacuuugaaacuggccaaaacacgagauucaccccagucggugucguccaggaugguagcaccacccacaaaaaugaaccccaacaaugggugcucccaagcuacucagguagagauagucacaauguacaccuagccccugcuguggccccuacuuuuccgggugagcaaauucuuuucuuuagguccacuaugcccggaugcagcggguaucccaacauggauuuggauugccuacucccccaggagugggugcagcacuucuaccaagagucagccccagcacaaucugauguggcacugcuaagauuugugaauccagacacagguaggguuuuguuugagugcaagcuccauaagucaggcuauguaacaguggcucacacuggccaacaugauuugguuaucccccccaauggcuauuuuagauuugauuccugggucaaccaauucuacacacuugcccccaugggaaauggagcggggcguagacgugcauuauaa

SEQ ID NO: 6486 - RNA, 1623 nt, Artificial Sequence
  major_capsid_protein__Norovirus__AFU92664
augaagauggcgucgaaugacgccaacccaucugauggguccgcagcccaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaacaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccgcggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaagucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6487 - RNA, 1623 nt, Artificial Sequence
  major_capsid_protein__Norovirus__AFU92666
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccaucccuugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaacuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6488 - RNA, 1623 nt, Artificial Sequence
  major_capsid_protein__Norovirus__AFU92667
augaagauggcgucgaaugacgccaccccaucugauggggucgcagcccaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccaguggugccuuuguuguucaaccacaaaauggcagaugcacgacugauggcgugcucuuagguaccacccaacugucuccugucaacaucugcaccuucagaggggaugucacccacauugcagguucucgcaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6489 - RNA, 1623 nt, Artificial Sequence
  major_capsid_protein__Norovirus__AFU92668
augaagauggcgucgaaugacgucaccccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6490 - RNA, 1623 nt, Artificial Sequence
  major_capsid_protein__Norovirus__AFU92669
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6491 - RNA, 1623 nt, Artificial Sequence
  major_capsid_protein__Norovirus__AFU92670
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggcgaaauacuauggcgcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccgaauuuuccaacugaaggcuugagucccagccaggucacuauguucccccacauaauaguggauguuaggcaauuggaaccuguguugauccccuuaccugauguuaggaauaacuuuuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaguuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucacuccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaacgguuauuuuagguuugauuccugggucaaucaauucuacacacuugcccccaugggaaauggaacggggcguagacgugcuuuauaa

SEQ ID NO: 6492 - RNA, 1623 nt, Artificial Sequence
  major_capsid_protein__Norovirus__AFU92671
augaagauggcgucgagugacgccaacccaucugauggguccacagccaaccucgucccagaggucaacaaugagguuauggcuuuggagcccguuguuggugccgcaauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaacaauuucuaucacuacaaucaaucaaaugaccccaccaucaaauugauagcaauguuguauacaccacuuagggcuaauaaugcuggggacgaugucuucacaguuucuugucgaguucucacgagaccaucccccgacuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaauggcaggugcacgacugauggcgugcuccuagguacuacccaauugucuccugucaacaucugcaccuucagaggggaugucacccacauugcagguacucaagaauacacaaugaaucuggccucucaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccagauuauucagguagagauagucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacgcuugcccccaugggaaauggaacggggcguagacgugcauuauaa

SEQ ID NO: 6493 - RNA, 1623 nt, Artificial Sequence
  major_capsid_protein__Norovirus__AFU92672
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaacuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaauacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguauccuaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6494 - RNA, 1623 nt, Artificial Sequence
  major_capsid_protein__Norovirus__AFU92673
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuugcuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagagaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugccacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6495 - RNA, 1623 nt, Artificial Sequence
  major_capsid_protein__Norovirus__AFU92674
augaagauggcgucgaaugacgcccacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaacuacacaaugaauuuggcuucucuaaauuggaccaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6496 - RNA, 1623 nt, Artificial Sequence
  major_capsid_protein__Norovirus__AFU92676
augaagauggcgucgagugacgcccacccaucugauggguccacagccaaccucgucccagaggucaacaaugaggucauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguauugaucccuuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguccaaccacaaaauggcaggugcacgacugauggcgugcucuuagguacuacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucguggguaagauccaaggcgugcucacccaaaccacaaguagggauggcucgacccgcggucacaaagccacagugagcacuggaaguguccacuucaccccaaagcugggcagaguucaauucuccacugauacaagcaaugauuuugaaacuggccaaaacacgagauucaccccagucgguguuguccaggaugguaguaccacccaucaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauuguuuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuacacacuugcccccaugggaaauggaacggggcguagacgugcauuauaa

SEQ ID NO: 6497 - RNA, 1623 nt, Artificial Sequence
  major_capsid_protein__Norovirus__AFU92677
augaagauggcgucgaaugacgcccacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauucacugucccaaucuuaacuguugaagaaaugaccaauucaagauuccccauuccuuuggaaaaauuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccggaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6498 - RNA, 1623 nt, Artificial Sequence
  major_capsid_protein__Norovirus__AFU92678
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacggguccuagcggugccuuuguuguucaaccacaaaauggcagaugcacgacugauggcgugcucuuagguaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaauaugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccauggguaauggaacggggcguagacgugcuuuauaa

SEQ ID NO: 6499 - RNA, 1623 nt, Artificial Sequence
  major_capsid_protein__Norovirus__AFU92679
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugaauuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccaugggaaauggaacggggcguagacgugcuuuauaa

SEQ ID NO: 6500 - RNA, 1623 nt, Artificial Sequence
  major_capsid_protein__Norovirus__AFU92680
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauucacugucccaaucuuaacuguugaagaaaugaccaauucaagauuccccauuccuuuggaaaaauuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccggaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6501 - RNA, 1623 nt, Artificial Sequence
  major_capsid_protein__Norovirus__AFU92681
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgccccuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacgaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaagucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6502 - RNA, 1623 nt, Artificial Sequence; identical to SEQ ID NO: 6501
  major_capsid_protein__Norovirus__AFU92682

SEQ ID NO: 6503 - RNA, 1623 nt, Artificial Sequence
  major_capsid_protein__Norovirus__AFU92684
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaacgaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 6504 - RNA, 1623 nt, Artificial Sequence
  major_capsid_protein__Norovirus__AFU92685
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagugcgcccuugggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaacaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaauggcaggugcacaacugauggcgugcuccuagguacuacccaacugucuccugucaacaucugcaccuucagaggggaugucgcccacauugcagguacucaagaauacacaaugaaucuggccucccaaaauuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggauggugguaccacccaccaaaaugaaccccaacaauggguacucccagauuauucagguagagauagucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacgugcacuauaa

SEQ ID NO: 6505 - RNA, 1623 nt, Artificial Sequence
  major_capsid_protein__Norovirus__AFU92686
augaagauggcgucgaaugacgcccacccaucugauggguccgcagccacccucgucccaaaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuauggagcgcgcccuuaggcccugaucugaaucccuaccuaucucauuuggccagaauguauaaugguuaugcaggugguuuugaacugcaugugcuccucgcggggaacgcguucaccgccggaaaaauuauaauugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaucuucagaggggaugucacccacauugcagguucucguaacuacacaaugaauuuggcugcucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaacgaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 6506 - RNA, 1623 nt, Artificial Sequence
  major_capsid_protein__Norovirus__AFU92687
augaagauggcgucgaaugaccccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcuuacucaaaccacaaagggggauggcucgacucguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6507 - RNA, 1623 nt, Artificial Sequence
  major_capsid_protein__Norovirus__AFU92688
augaagauggcgucgaaugacgcccacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaccuccagauuucgugggaaagauccaaggugugcuuacucaaaccacaaagggggauggcucgacucguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6508 - RNA, 1623 nt, Artificial Sequence
  major_capsid_protein__Norovirus__AFU92689
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcuuacucaaaccacaaagggggauggcucgacucguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6509 - RNA, 1623 nt, Artificial Sequence; identical to SEQ ID NO: 6508
  major_capsid_protein__Norovirus__AFU92690

SEQ ID NO: 6510 - RNA, 1623 nt, Artificial Sequence; identical to SEQ ID NO: 6508
  major_capsid_protein__Norovirus__AFU92691

SEQ ID NO: 6511 - RNA, 1623 nt, Artificial Sequence
  major_capsid_protein__Norovirus__AFU92692
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaaccccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucauaccggccagcaugacuuggucaucccccccaauggcuauuuuagguuugauuccuggguuaaucaauucuacacacuugcccccaugggaaauggaacggggcguagacgugcuuuauaa

SEQ ID NO: 6512 - RNA, 1623 nt, Artificial Sequence
  major_capsid_protein__Norovirus__AFU92693
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaguaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuucccaacugaaggcuugagucccagccaggucacuauguucccccacauaauaguggaugucaggcaauuggaaccuguguugauccccuuaccugauguuaggaauaauuucuaucacuauaaucagucgaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaauaucugcaccuucagaggggaugucacucacauugcagguucucguaauuacacaaugaauuuggcuucucuaaauuggaacaauuaugauccaacagaagaaauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuccauaaaucaggcuaugucacaguggcucacaccggccagcaugauuugguuaucccccccaaugguuauuucagguuugauuccuggguuaaucaauucuacacacuugcccccaugggaaauggaacggggcguagacgugcuuuauaa

SEQ ID NO: 6513 - RNA, 1623 nt, Artificial Sequence
  major_capsid_protein__Norovirus__AFU92694
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuuaagccccagccaggucacuauguucccccacauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguacucacgagaccaucccccgauuuugauuuuauauuuuuagugccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuaggcaccacccaacugucuccugucaacaucugcaccuucagaggggaugucacccauauuacagguagucguaacuacacaaugaauuuggcuacccaaaauuggaacaguuaugacccaacagaagaaaucccagccccucuaggaacuccagauuucguggggaagauccaaggugugcucacccaaaccacaagggcagauggcucgacccgcggccauaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaauguacaccuggcccccgcuguagcccccacuuuuccgggugagcaacuucucuucuucagauccacuaugcccggaugcagcggguaccccaacauggauuuggacugucugcucccccaggaaugggugcaguauuuuuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuucagauuugauuccugggucaaccaguucuacacacuugcccccaugggaaauggaacggggcguagacgugcauuauaa

SEQ ID NO: 6514 - RNA, 1623 nt, Artificial Sequence
  major_capsid_protein__Norovirus__AFU92695
augaagauggcgucgaaugacgcuaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucacugccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugagcaacuucuuuucuuuagguccacuaugcccggaugcagcggguaucccaacauggauuuggacugccugcucccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaauggcuauuuuagguuugauuccuggguuaaucaguucuacacacuugcccccaugggaaauggaacggggcguagacgugcuuuauaa

SEQ ID NO: 6515 - RNA, 1623 nt, Artificial Sequence
  major_capsid_protein__Norovirus__AFU92696
augaagauggcgucgaaugacgccaacccaucugauggguccgcagccaaccucgucccagaggucaacaaugagguuauggcuuuggagcccguugucggugccgcuaucgcggcgccuguagcgggccaacaaaauguaauugaccccuggauuagaaauaauuuuguacaagccccugguggagaguucacaguauccccuaggaacgcuccaggugaaauacuauggagcgcgcccuuaggcccugaucugaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaacuucuaucauuauaaccagucaaaugauucuaccauuaaauugauagcaaugcuguauacaccacuuagggcuaauaaugcuggggaagaugucuucacagucuccugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccagcugucuccugucaacaucugcaccuucagaggggaugucacccacauugcagguucucguaauuacacaaugaauuuggcuucucuaaauuggaacaauuaugacccuacagaagaaauuccagccccucuaggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugauacagaaaaugacuuugaaacucaccaaaacacaaaauucaccccagucggugucauucaggaugguggcaccacccaccgaaaugaaccccaacaaugggugcucccaagcuauucagguagaaauguccaaaaugugcaccuagccccugcuguagcccccacuuucccgggugaacaacuucuuuucuuuagguccacuaugcccggauguagcggguaucccaacauggauuuggauugccuacucccccaggagugggugcagcacuucuaccaggaggcagcuccagcacaaucugauguggcucuauugagauuugugaauccagacacggguaggguccuguuugagugcaaacuucauaaaucaggcuaugucacaguggcucacaccggccagcaugauuugguuaucccccccaaugguuauuuuagguuugauuccugggucaaucaauucuacacacuugcccccaugggaaauggaacggggcguagacgugcuuuauaa

SEQ ID NO: 6516 - RNA, 1623 nt, Artificial Sequence
  major_capsid_protein__Norovirus__AFU92697
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucacugccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuacuauuaaauugauagcaauguuguauacaccacuuagggcuaauaaugcuggggaagaugucuuuacagucucuugucgaguucucacgaggccauccccugacuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugagcaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaaacuucacaaaucaggcuauguuacaguggcucacaccggccagcaugauuuggucaucccccccaauggcuauuuuagguuugauuccuggguuaaucaguucuacacacuugcccccaugggaaauggaacggggcguagacgugcuuuauaa

SEQ ID NO: 6517 - RNA, 1623 nt, Artificial Sequence
  major_capsid_protein__Norovirus__AFU92698
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuaucucauuuggccagaauguauaauggcuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6518 - RNA, 1623 nt, Artificial Sequence
  major_capsid_protein__Norovirus__AFU92699
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuacuuaucucauuuggccagaauguauaauggcuaugcaggugguuuugaagugcaggugauccucgcggggaacgcguucaccgccgggaaaauuauauuugcagcagucccaccaaauuuuccaacugaaggcuugagccccagucaggucacuauguucccccacauaauacuagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccgccgaaaugaaccccaacaaugggugcucccaaguuauucagguagaaaugcccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6519 - RNA, 1623 nt, Artificial Sequence
  major_capsid_protein__Norovirus__AFU92700
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaacgguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacugucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacgacugacggcgugcucuuaggcaccacccaacugucuccugucaacaucugcaccuucagaggggaugucacccacauugcagguucucgugacuacacaaugaauuuggccucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguagcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacgugcuuuauaa

SEQ ID NO: 6520 - RNA, 1623 nt, Artificial Sequence
  major_capsid_protein__Norovirus__AFU92701
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggaugucagacaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaggaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaaggugugcucacucaaaccacaaagggagauggcucgacccguggccauaaagcuacagucuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucauaccggccagcaugauuuggucaucccccccaaugguuauuuuagguuugauuccuggguuaaucaauucuacacacuugcccccaugggaaaugggacggggcguagacgugcuuuauaa

SEQ ID NO: 6521 - RNA, 1623 nt, Artificial Sequence
  major_capsid_protein__Norovirus__AFU92702
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaccccuaccuuucucauuuggccagaauguacaaugguuaugcaggugguuuugaagugcagguaauccucgcggggaacgcguucaccgccggaaaaauuauauuugcagcagucccaccaaauuucccaacugaaggcuugagccccagccaggucacuauguucccccacauaauaguagauguuaggcaauuggaaccuguguugaucccccuacccgauguuagaaauaauuucuaucacuacaaccaaucaaaugaccccaccaucaaauugauagcaauguuguauacaccacuuagggccaauaaugcuggggacgaugucuucacagucucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacagcuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugacacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuacuuuagauuugauuccugggucaaccaguucuacacacuugcccccaugggaaauggaacggggcguagacgugcauuauaa

SEQ ID NO: 6522 - RNA, 1623 nt, Artificial Sequence
  major_capsid_protein__Norovirus__AFU92703
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagcuccugguggagaguucacaguauccccuagaaacgcuccaggugaaauacuauggagcgcgcccuuaggcccugaucugaaccccuaccuaucccauuuggccagaauguauaaugguuaugcaggugguuuugaagugcaagugauccucgcggggaacgcguucaccgccgggaaaaucauauuugcagcagucccaccaaauuuuccaacugagggcuugagccccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaggauguuuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggcaugcucacucaaaccacaaagggagaugguucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguagcaccacccaccggaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6523 - RNA, 1623 nt, Artificial Sequence
  major_capsid_protein__Norovirus__AFU92704
augaagauggcgucgagugacgccaacccaucugauggguccacagcccaccuugucccagaggucaacaaugagguuauggcuuuggagcccguaguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcaaguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguagaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6524 - RNA, 1623 nt, Artificial Sequence
  major_capsid_protein__Norovirus__AFU92705
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagguuccccauuccucuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauucaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6525 - RNA, 1623 nt, Artificial Sequence
  major_capsid_protein__Norovirus__AFU92706
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6526 - RNA, 1623 nt, Artificial Sequence
  major_capsid_protein__Norovirus__AFU92707
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguugaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6527 - RNA, 1623 nt, Artificial Sequence
  major_capsid_protein__Norovirus__AFU92708
augaagauggcgucgaaugacgccaacccaucugauggguccgcagccaaccucgucccagaggucaacaaugagguuauggcuuuggagcccguuguuggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccaucccccgauuuugauuuuauauuuuuggugccaccuacaguugagucaagaacuaaaccauuuacugucccaaucuuaacuguugaagaaaugacuaauucgagauuccccauuccuuuggaaaaguuguucacgggucccagcggugccuuuguuguucaaccacaaaauggcaggugcacgaccgauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaacuccagauuucguggggaagauccaaggugugcucacccaaaccacaaagggagauggcucgacccguggccauaaagcuacaguuuacacugggagugccgacuucacuccaaagcugggcaguguucaauucagcacugauacagaaaaugauuuugaaacucaccaaaacacaaaguucaccccagucggugucauccaggaugguagcaccacccaucgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaccccaacaugaauuuggauugccuaaucccccaggagugggugcagcacuucuaccaagaagcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauuuuacacacuugcccccaugggaaauggagcggggcguagacgugcuuuauaa

SEQ ID NO: 6528 - RNA, 1623 nt, Artificial Sequence
  major_capsid_protein__Norovirus__AFU92709
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaauuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcccacacuggccaacaugauuugguuaucccccccaaugguuauuuuagauuugauuccugggucaaccaguucuacacacuugcccccaugggaaaugggacggggcguagacgugcauuauaa

SEQ ID NO: 6529 - RNA, 1623 nt, Artificial Sequence
  major_capsid_protein__Norovirus__AFU92710
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuucguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugacuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6530 - RNA, 1623 nt, Artificial Sequence
  major_capsid_protein__Norovirus__AFU92711
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuucguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6531 - RNA, 1623 nt, Artificial Sequence
  major_capsid_protein__Norovirus__AFU92712
augaagauggcgucgaaugacgccaacccaucugaaggguccgcagccaaccucgucccagaggucaacaaugagguuauggcuuuggagcccguugucggugccgcuauugcggcaccuguagcgggccaacaaaauguaauugaccccuggauuagaaauaauuuuguacaagccccugggggggaguucacaguauccccuagaaacgcuccaggcacgauacgauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugaugucaggaauaacuucuaucauuauaaucagucaaaugauucuaccauaaaauugauagcaauguuguauacaccacuuagggcuaauaaugcuggggaagaugucuucacagucucuugucgaguccucacgaggccaucccccgauuuugauuuuauauuuuuggugccacccacaguugagucaagaacuaaaccauuuacugucccaaucuuaacuguugaagaaaugacuaauucgagauucuccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccugccccucuaggaacuccagauuucguggggaagauccaaggugugcucacucaaaccacaaagggagauggcucgacccguggccauaaagcuacaguuuacacugggagugccgacuucacuccaaagcugggcaguguucaauucaguacugauacagaaaaugauuuugaaucucaccaaaacacaaaauucaccccagucggcgucauccaggaugguagcaccacccaucgaaaugaaccccaacaaugggugcucccaaguuauucagguagaaauguccauaauguacaccuagccccugccguggcccccacuuuuccgggugaacaacuucuuuucuucagguccacuaugcccggaugcagcggguaucccaacauggauuuggauugccuaaucccccaagagugggugcagcacuucuaccaagaggcagcuccagcacaaucugauguggcucuauugagauuugugaauccagacacggguaggguccuguuugagugcaaacuccauaaaucaggcuaugucacaguggcucacaccggucagcaugauuuggucaucccccccaauggcuacuuuagguuugauuccuggguuaaucaauucuacacacuugcccccaugggaaauggagcggggcguagacgugcuuuauaa

SEQ ID NO: 6532 - RNA, 1623 nt, Artificial Sequence
  major_capsid_protein__Norovirus__AFU92713
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggccaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguucuccauuccuuuggaaaaauuguucacgggccccaguagugccuuuguuguucaaccacaaaacggcaggugcacgacugauggcgugcuucuagguacuacccaacugucucccgucaacaucugcaccuucagaggggacgucacccauauuccaggcagucguaacuacacaaugaauuuggccucccaaaauuggaacaguuacgauccaacagaagagaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6533 - RNA, 1623 nt, Artificial Sequence
  major_capsid_protein__Norovirus__AFU92714
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcaaguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6534 - RNA, 1623 nt, Artificial Sequence
  major_capsid_protein__Norovirus__AFU92715
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguucuccauuccuuuggaaaaguuguucacgggccccaguagugccuuuguuguucaaccacaaaacggcaggugcacgacugauggcgugcuccuagguacuacccaacugucucccgucaauaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6535 - RNA, 1623 nt, Artificial Sequence
  major_capsid_protein__Norovirus__AFU92717
augaagauggcgucgagugaccccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaaguacagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaccauuauaaucaaucaaacgacuccaagcucaaauugagaccgauguuguacacaccacuuagggcuaauaaugccggggacgaugucuucacaguuucuugucggguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaagcuggguagaguucaauuugccacugacacagacaaugauuuugaaacuaaccaaaacacaaaauucaccccagucggcguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6536 - RNA, 1623 nt, Artificial Sequence
  major_capsid_protein__Norovirus__AFU92718
augaagauggcgucgaaugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaauuauauuugcagcagucccaccaaacuucccaacugaaggcuugagccccagccaggucacuauguucccccacauaauaguagauguuagacaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccucgauuuugauuuuauauucuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucauccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaacggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcaggaacauucacaaugugcaccuggcccccgcuguagcccccaccuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugacuccugggucaaccaguucuacacacuugcccccaugggaaaugggacggggcguagacgugcauuguaa

SEQ ID NO: 6537 - RNA, 1623 nt, Artificial Sequence
  major_capsid_protein__Norovirus__AFU92719
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaaaauccaaggugugcucacucaaaccacaaagggagauggcucgacccguggccauaaagcuacaguuuacacugggagugcccccuucacuccaaagcugggcaguguccaauucaguacugauacagaaaaugacuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuauguuacaguggcucacaccggccagcaugauuuggucaucccccccaaugguuauuuuagguuugauuccuggguuaaucaauucuacacgcuugcccccaugggaaauggaacggggcguagacgugcuuuauaa

SEQ ID NO: 6538 - RNA, 1623 nt, Artificial Sequence
  major_capsid_protein__Norovirus__AFU92720
augaagauggcgucgagugacgcccacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccacuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccacuauaaucaaucaaaugaccccaccaucaaauugauagcaauguuguauacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguuuacgggucccaguagugccuuuguuguucaaccacaaaacggcaggugcacgacugauggcgugcuccuaggcacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaacaacaaggacaaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucggcguuauccaggauggcaguacuaccccccgaaaugaaccccaacaaugggugcucccaaguuacucaggcagaaacauucauaaugugcaccuggcccccgcuguggcccccacuuucccgggcgagcagcuccucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6539 - RNA, 1623 nt, Artificial Sequence
  major_capsid_protein__Norovirus__AFU92721
augaagauggcgucgagugacgcccacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaguaguagauguuaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagauaaugauuuuguaacuaaccagaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaucccaacauggauuuggacugucugcucccccaggaaugggugcaguauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuauccccccuaaugguuauuuuagauuugauuccugggucaaccaguucuacacacuugcccccaugggaaaugggacggggcguagacgugcauuauaa

SEQ ID NO: 6540 - RNA, 1623 nt, Artificial Sequence
  major_capsid_protein__Norovirus__AFU92722
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuguggagcgcgcccuuaggcccugauuugaaucccuaccuuucccauuuggccagaauguacaacgguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuauuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucagguuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 6541 - RNA, 1623 nt, Artificial Sequence
  major_capsid_protein__Norovirus__AFU92723
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuucgaagugcagguaauccucgcggggaaugcguucaccgccgggaaaaucauauuugcagcagucccaccaaauuucccaacugaagguuugagccccagccaagucacuauguucccccacauaguaguagauguuaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagauaaugauuuuguaacuaaccagaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccgggugcagcggguaucccaacauggauuuggacugucugcucccccaggaaugggugcaguauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacgugcauuguaa

SEQ ID NO: 6542 - RNA, 1647 nt, Artificial Sequence
  major_capsid_protein__Norovirus__AGD79474
augaagauggcgucgaaugacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaauuuugugcaagcaccugguggugaguuuacaguauccccuaggaauuccccuggugaagugcuucuuaauuuggaauugggcccagaaauaaaucccuauuuggcccaucuugcuagaauguauaaugguuaugcagguggauuugaagugcagguaguccuagcuggaaaugcguuuacagcaggaaagauaaucuuugcagcuauacccccuaauuuuccaauugauaaucuaagcgcagcacagaucacaaugugcccacaugugauuguggaugucagacaguuggaaccggucaaccucccgaugccugacguucgcaacaacuucuuucauuacaaucaagggucugauucgagauugcgcuuaauugcaaugcuguauacaccucuuagggcaaauaauucuggggaugauguuuuuacugugucuuguagagugcugacuaggccuagcccugacuuuucauuuaauuuccuugugccaccuacuguggagucaaagacaaaacccuuuacccucccuauucugacuaucucugaaauguccaauucuagguuuccagugccgauugauucucugcacaccagcccaacugagaauaucguuguccagugccaaaaugggcgcgucacucuugauggugaguugaugggcaccacccaacucuuaccuagucaaaucugugcuuuuaggggcgugcucaccagaucaacaagcagggccagugaucaggccgacacagcaaccccuagguuguuuaauuauuauuggcacauacaauuggauaaucuaaaugggacuccuuaugauccugcagaagacauaccaggcccccuagggacaccagauuuccggggcaaagucuuuggcguggccagccagagaaaucccgacagcacaacuagagcacaugaagcaaagguggacacaacagcuggucguuucaccccaaaacuaggcucauuagagauauccacugaaucugaugacuuugaucaaaaccaaccaacaagauucaccccaguuggcauugggguugaccgugaggcagacuuucaacaauggucuuuacccgacuauucuggucaguucacccacaacaugaacuuagccccagcuguugcucccaacuucccuggugagcagcuccuuuucuuucgcucacaguuaccauccucuggugggcgauccaacgggguucuagacugccuggucccccaagaauggguucagcacuucuaccaagaaucggcccccgcccaaacucaaguggcccugguuagguaugucaacccugacacugguagaguauuauuugaggccaagcugcacaaacuagguuucaugacuauagcuaagaauggugacucuccaauaacugucccuccaaauggauauuuuagguuugaaucuugggugaaccccuuuuauacacuugcccccaugggaacugggaaugggcguagaaggguucaauaa

SEQ ID NO: 6543 - RNA, 1647 nt, Artificial Sequence
  major_capsid_protein__Norovirus__AGD79475
augaagauggcgucgaaugacgccacuccaucuaaugauggugccgccggccucgucccagagaucaacaaugaggcaauggcgcuagacccaguggcgggugcagcgauagcagcaccccucacuggucagcaaaauauaauugaucccuggauuaugaauaauuuugugcaagcaccugguggugaguuuacaguauccccuaggaauuccccuggugaagugcuucucaauuuggaauugggcccagaaauaaaucccuauuuggcccaucuugcuagaauguauaaugguuaugcagguggauuugaagugcagguaguccuagcuggaaaugcguuuacagcaggaaagauaaucuuugcagcuauacccccuaauuuuccaauugauaaucuaagcgcagcacagaucacaaugugcccacauguaauuguggaugucagacaguuggaaccggucauccucccgaugccugacguucgcaacaacuucuuucauuacaaucaagggucugauucgagauugcgcuuaauugcaaugcuguauacaccucuuagggcaaauaauucuggggaugauguuuuuacugugucuuguagagugcugacuaggccuagcccugauuuuucauuuaauuuccuugugccaccuacuguggagucaaagacaaaacccuucacucucccuauucugacuaucucugaaauguccaauucuagguuuccagugccgauugauucucugcacaccagcccaacugagaauauuguuguccagugccaaaaugggcgcgucacucuugauggugaguugaugggcaccacccaacucuuaccuagucaaaucugugcuuucaggggcgugcucaccagaucaacgagcagggccagugaucaggccgacacaguaaccccuagguuguuuaauuauuauuggcacauacaauuggauaaucuaaaugggacuccuuaugauccugcagaagacauaccaggcccccuagggacaccagauuuccggggcaaagucuuuggcguggccagccagagaaaucccgacagcacaacuagagcacaugaagcaaaaguggacacaacagcuggucguuucaccccaaaacuaggcucauuagagauauccaccgaaucugaugacuuugaucaaaaccaaccaacaagauucaccccaguuggcauugggguugaccgugaggcagacuuucaacaauggucuuuacccgauuauucuggucaguucacccacaacaugaacuuagccccagcuguugcucccaacuucccuggugagcagcuccuuuucuuccgcucacaguuaccauccucuggugggcgauccaacgggauucuagacugccuggucccccaagaauggguucagcacuucuaccaagaaucggcacccgcccaaacucaaguggcucugguuagguaugucaacccugacacugguagaguauuauuugaggccaagcugcacaaauuagguuucaugacuauagcuaagaauggugacucuccaauaacugucccuccaaauggauacuuuagguuugaaucuugggugaacccauuuuauacacuugcccccaugggaacugggaaugggcguagaaggauucaauaa

SEQ ID NO: 6544 - RNA, 1647 nt, Artificial Sequence
  major_capsid_protein__Norovirus__AGD79476
augaagauggcgucgaaugacgccgcuccaucuaaugauggugccgccggccucgucccagagaucaacaaugaggcaauggcgcuagagccaguggcgggugcagcgauagcagcaccccucacuggucagcaaaacauaauugaucccuggauuaugaauaauuuugugcaagcaccugguggugaguuuacaguguccccuagaaauuccccuggugaaguucuucuuaauuuggaacugggcccagaaauaaaucccuauuuggcccaucuugcuagaauguauaaugguuaugcagguggauuugaagugcaggugguccuagcuggaaaugcguuuacagcaggaaagauaaucuuugcagcuauuccccccaauuuuccaauugacaaucuaagugcagcacagaucacaauguguccacaugugauuguggaugucagacaguuggaaccagucaaccucccgaugccugacguucgcaacaacuucuuccauuacaaucaagggucugauucgagauugcgccuaauugcaaugcuauacacaccucuuagggcaaauaauucuggggaugauguuuuuacugugucuugcagagugcuaacuagaccuaguccugacuucucauuuaauuuccuugugccaccuacuguggagucaaagacaaaacccuuuucccucccuauucugacuaucucugaaauguccaauucuagguucccaguaccaauugauucucugcacaccagccccacugagaauauuguuguccagugccagaaugggcgagucacccuugauggugaguugaugggcaccacccagcucuuaccuagccaaaucugugcuuucaggggcgugcucaccaggucaacaagcagggccagugaccaggccgauacagcaaccccuagauuguuuaauuauuauuggcauauacaauuggauaaucuaaauggaacuccuuaugauccugcagaagacauaccaggcccccuagggacaccagauuuccggggcaaagucuuuggcguggccagccagagaaauccugauaccacgacuagggcacaugaagcaaagguagacacaacauccggccguuucaccccaaaacuaggcucauuagagauauccacugaaucugaugauuuugaucaaaacaaaccaacaagauucaccccaguuggcauugggguugaccaugaggcagacuuucaacaauggacucuacccgacuaugcuggccaguucacccacaacaugaacuuagccccagcuguuguucccaacuuuccuggugagcagcuccuuuucuuccgcucacaguugccauccucuggugggcgauccaacgggauucuagacugccuggucccccaagaauggguacagcacuucuaccaagaaucagcccccucccaaucucaaguggcccugguuagguauaucaacccugacacugguagaguguuauuugaggccaagcugcacaaauuagguuucaugacuauagccaagaauggugauucuccaauaacugucccuccaaauggauacuuuagguuugaaucuugggugaaccccuuuuauacacuugcccccaugggaacuggaaaugggcguagaaggauucaauaa

SEQ ID NO: 6545 - RNA, 1647 nt, Artificial Sequence
  major_capsid_protein__Norovirus__AGD79477
augaagauggcgucgaaugacgccgcuccaucuaaugauggugccgccggccucgucccagagaucaacaaugaggcaauggcgcuagagccaguggcgggugcagcgauagcagcaccccucacuggucagcaaaauauaauugaucccuggauuaugaauaauuuugugcaagcaccugguggugaguuuacaguauccccuagaaauuccccuggugaaguucuucuuaauuuggaacugggcccagaaauaaaucccuauuuggcccaucuugcuagaauguacaacgguuaugcagguggauuugaagugcaggugguccuagcuggaaaugcguuuacagcaggaaagauaaucuuugcagcuauuccccccaauuuuccaauugacaaucuaagugcagcacagaucacaaugugcccacaugugauuguggaugucagacaguuggaaccagucaaccucccgaugccugacguucgcaacaacuucuuucauuacaaucaagggucugauucgagauugcgccuaauugcaauguuauacacaccucuuagggcaaauaauucuggggaugauguuuuuacugugucuugcagagugcuaacuagaccuaguccugacuucucauuuaauuuccuugugccaccuacuguggagucaaagacaaaacccuuuucccucccuauuuugacuaucucugaaauguccaauucuagguucccaguaccaauugauucucugcacaccaguccuacugagaauauuguuguccagugccagaaugggcgugucacccuugauggugaguugaugggcaccacccaacucuuaccuagccaaaucugugcuuucaggggcguucucaccagaucaacaagcagggccagugaccaggccgauacagcaaccccuagauuguuuaauuauuauuggcacauacaauuggauaaucuaaauggaacuccuuaugauccugcagaagacauaccagguccccuagggacaccagauuuucggggcaaagucuuugguguggccagccagagaaauccugauaccucgacuagggcacaugaagcaaagauagacacaacaucuggccguuucaccccaaaacuaggcucauuagagauauccacugaaucugaugauuuugaucaaaacaaaccaacaagauucaccccaguuggcauugggguugaccaugagacagacuuucaacaauggacucuacccgacuacgcuggccagcucacccacaacaugaacuuagccccagcuguugcucccaacuucccuggugagcagcuccuuuucuuccgcucacaguugccaucuucuggugggcgauccaacgggauucuagacugccuggucccccaagaaugggugcagcacuucuaccaggaaucagcccccucccaaucucaaguggcccugguuagguauaucaacccugacacugguagaguguuauuugaggccaagcugcacaaauuagguuucaugacuauagccaagaauggugacucuccaauaacugucccuccaaauggauacuuuagguuugaaucuugggugaaccccuuuuacacacuugcccccaugggaacugggaacgggcguagaaggauucaauaa

SEQ ID NO: 6546 - RNA, 1647 nt, Artificial Sequence
  major_capsid_protein__Norovirus__AGD79478
augaagauggcgucgaaugacgccgcuccaucuaaugauggugccgccggccucgucccagagaucaacaaugaggcaauggcgcuagagccaguggcgggugcagcgauagcagcaccccucaccggucagcaaaauauaauugaucccuggauuaugaauaauuuugugcaagcaccugguggugaguuuacaguauccccuagaaauuccccuggugaaguccuucucaauuuggaauugggcccagaaauaaaucccuauuuggcccaucuugcuagaauguauaaugguuaugcagguggauuugaagugcaggugguccuagcuggaaaugcguuuacagcaggaaagauaaucuuugcagcuauuccccccaauuuuccaauugacaaucuaagugcagcacagaucacaauguguccacaugugauuguggaugucagacagcuggaaccagucaaccucccgaugccugacguucgcaacaacuucuuucauuacaaucaagggucugauucgagauugcgccuaauugcaaugcuauauacaccucuuagggcaaauaauucuggggaugauguuuuuacugugucuugcagagugcuaacuagaccuaguccugacuucucauuuaauuuccuugugccacccacuguagagucaaagacaaaacccuuuucccuaccuauuuugacuaucucugaaauguccaacucuagguucccaguaccaauugauucucugcacacuagcccuacugagaauauuguuguccagugucagaaugggcgcgucacccuugauggugaguugaugggcacuacccaacucuuaccuagccaaauuugugcuuucaggggcgugcucaccagaucaacaagcagggccagugaccaggccgauacagcaaccccuagauuguuuaauuauuauuggcauauacaauuggauaaucuaaaugaaacuccuuaugacccugcagaagguauaccaggcccccuagggacaccagauuuucggggcaaagucuucggcguggccagccagagaaauccugauacuacaacuagagcgcaugaagcaaagguagacacaacaucuggccguuucaccccaaaauuaggcucauuagaaauuuccacugaaucugaugauuuugaucaaaauaaaccaacaagauucaccccaguuggcauugggguugaccaugaggcagacuuucaacaauggacucuucccgacuaugcuggccaguucacccacaacaugaacuuagccccagcuguugcucccaacuucccuggugagcaacuccuuuucuuccgcucacaguugccauccucuggugggcgauccaacgggauucuagacugccuggucccccaagaauggguacagcacuucuaccaagaaucagcccccucccaaucucaaguggcccugguuagguauaucaacccugacacugguagaguguuauuugaggccaagcugcauaaauuagguuucauaacuauagccaagaauggugacucuccaauaacugucccuccaaauggauacuuuagguuugaaucuugggugaaccccuuuuauacacuugcccccaugggaacagggaaugggcguagaaggauucaauaa

SEQ ID NO: 6547 - RNA, 1647 nt, Artificial Sequence
  major_capsid_protein__Norovirus__AGD79479
augaagauggcgucgaaugacgccgccccaucuaaugauggugccgccggccucgucccagagaucaacaaugaggcaauggcgcuagagccaguggcaggugcagcgauagcagcaccccucaccggucagcaaaauauaauugaucccuggauuaugaauaauuuugugcaagcaccugguggugaguuuacaguguccccuagaaauuccccuggugaaguucuucuuaauuuggaauugggcccagaaauaaaucccuauuuggcccaucuugcuagaauguauaaugguuaugcagguggauuugaagugcaggugguccuagcuggaaaugcguuuacagcaggaaagauaaucuuugcagcuauuccccccaauuuuccaauugacaaucuaagugcagcacagaucacaauguguccacaugugauuguggaugucagacagcuggaaccagucaaccucccgaugccugacguucgcaacaauuucuuucacuacaaucaagggucugauucgagauugcgccuaauugcaauguuauauacaccucuuagggcaaauaauucuggggaugauguuuuuacugugucuugcagagugcuaacuagaccuaguccugacuucucauuuaauuuccuugugccacccacuguggagucaaagacaaaacccuuuucccuaccuauuuugacuaucucugaaauguccaauucuagguucccaguaccaauugauucucugcacacuagcccuacugagaauauuguuguccagugucagaaugggcgcgucacccuugauggugaguugaugggcacuacccaacucuuaccuagccaaauuugugcuuucaggggcgugcucaccagaucaacaagcagggccagugaccaggccgauacagcaaccccuagauuguuuaauuauuauuggcauauacaauuggauaaucuaaauggaacuccuuaugacccugcagaagauauaccaggcccccuagggacaccagauuuucgaggcaaaguuuucggcguggccagccagagaaauccugauacuacaacuagagcgcaugaagcaaagguagacacaacaucuggccgcuucaccccaaaauuaggcucauuagaaauuuccacugaaucugaugauuuugaucaaaauaaaccaacaagauucaccccaguuggcauugggguugaccaugaggcagacuuucaacaauggacucuucccgacuaugcuggccaguucacccacaacaugaacuuagccccagcuguugcucccaacuucccuggugagcaacuccucuucuuccgcucacaguugccaucuucuggugggcgaaccaacgggauucuagacugccuggucccccaagaaugggugcagcacuucuaccaagaaucagcccccucccaaucucaaguggcccugguuagguacaucaacccugacacagguagaguguuauuugaggccaagcugcauaaauuagguuucauaacuauagccaagaauggugacucuccaauaacuguccccccaaauggauacuuuagguuugaaucuugggugaaccccuuuuauacacuugcccccaugggaacagggaaugggcguagaaggauucaauaa

SEQ ID NO: 6548 - RNA, 1620 nt, Artificial Sequence
  major_capsid_protein__Norovirus__AGH24750
augaagauggcgucgaaugacaccaucccaucugaugggucgacagccaaccucgucccagaggucaacaaugagguuauggcuuuggagccuguuguuggagcugcuauugcagccccaguggcaggucaacaaaauguaauugaccccuggauuagaaauaauuuugugcaagcccccgguggagaguucacgguuuccccuagaaaugccccaggugaaauauuguggaguaugccacugagcccugauuugaaccccuaccuaucacacuuguccaggauguacaauggguaugcaggugguuuugaggugcaggugauccuugcggggaaugcguucaccgcggggaagaucauauucgccgcaauuccaccaaauuuucccacugauggccugaguccuagucaggucaccauguuuccucacauaauuguggauguuaggcaauuggaaccaguguugauccccuuaccugauguuagaaauaauuucuaucauuauaaucagguuaaugauuccacuuugaagcugauagcuauguuguacacaccacuuagagcuaacaaugcuggggaugauguuuucacugucucuugucgugugcugacacgaccauccccugauuuugauuucauauucuugguccccccuacaguugagucaagaacaaagccuuucacuguccccauauugacuguugaugagaugacuaauucuagguuucccaccccccuggaaagauugcacacgggcccaaacaauucucuggucguccagccccaaaaugggaggugcacaauugaugguguucuuuugggcaccacgcaguugucagcugucaacaucugcagcuuuagaggggauagcaccacacgugaaggccagucacaugccuacacgaugaauuuggcuucucaaaacuggacuaauuaugacccaacagaggacauaccagcuccuuuggggacaccagauuuuguuggaaagaucgugggcaugcucucgcagaccaccagagaaaacagcucaacgcgagcccacaaggccacggugagcacuggggacgcccacuucaugccaaagcuaggcaguguuuuguucaccacugacacugaagaucuccagaauggccagaacacaagauucaccccaguuggagucgcacaagauggcgaaccccaccagaaugagccacaacaauggcgacucccaaauuauucuggaacaccaggccauaaugugcacuuggcacccccagucgcccccaccuucccaggugaacaguugcucuucuucagaucuaccaugccuggguguggcggcuaccccaauauggauuuggauugccuacucccccaagaauggguacgccauuucuaucaagaggccgcaccagcacagucugauguagcccugcugagguuugugaauccagauacgggaagggugcuguuugagugcaagcuccacaaggcaggguacaucacagucucccacacuggucccuaugaucuggucaucccaccuaauggcuacuuuagauuugauuccugggucaaucaauuuuaugcacuugcccccaugggaacuggaacggggcgcaggcgugcauuauaa

SEQ ID NO: 6549 - RNA, 1623 nt, Artificial Sequence
  major_capsid_protein__Norovirus__AGI37922
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagccauguuguauacaccacuuagggcuaauaaugcuggggacgaugucuucacaguuucuugucggguucucacgagaccaucccccgauuuugacuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcagaugcacgacugauggcgugcuccuagguaccacucaacugucuccugucaacaucugcaccuucagaggggaugucacccauaucacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugacacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugccugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuuuagauuugauuccugggucaaccaguucuacacacuugcccccaugggaaauggaacggggcguagacgugcauuauaa

SEQ ID NO: 6550 - RNA, 1623 nt, Artificial Sequence
  major_capsid_protein__Norovirus__AGM46344
augaagauggcgucgaaugacgccaacccaucugauggguccacagccaaccucgucccagaggucaacaaugagguuauggcuuuggagcccguuguuggugccgccauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaauugauagccauguuguauacaccacuuagggcuaauaaugcuggggacgaugucuucacaguuucuugucggguacucacgagaccaucccccgauuuugauuucauauuucuagugccacccacaguugaaucaagaacuaaaccauucucugucccaauuuuaacuguugaggagaugaccaauucaagauuccccauuccuuuggaaaagcuguucacgggcccuagcagugccuuuguuguucaaccacaaaacggcaggugcacgacugauggcgugcuccuggguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggccacaaagcuacaguguacacugggagcgccgacuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggcgagcaacuucucuucuucagauccacuaugcccggaugcagcggguaccccaacauggauuuggacugucugcuuccccaggaaugggugcaguauuucuaucaagaggcagccccagcacaaucugauguggcacugcuaagauuugugaauccagacacagguaggguuuuguuugaguguaagcuucauaaaucaggcuauguuacuguggcucacaccggccaacaugauuugguuaucccccccaaugguuauuucagauuugauuccugggucaaccaguucuacacacuugcccccaugggaaauggaacggggcguagacgugcauuauaa

SEQ ID NO: 6551 - RNA, 1623 nt, Artificial Sequence
  major_capsid_protein__Norovirus__AGM46347
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaauucacaguauccccuaggaacgcuccaggugaaauacuguggagcgcgccccuaggcccugauuugaauccuuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuucacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuuucuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucagguagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuucagauuugauuccugggucaaccaguucuacacacuugcccccaugggaaauggaacggggcguagacgugcauuauaa

SEQ ID NO: 6552 - RNA, 1623 nt, Artificial Sequence
  major_capsid_protein__Norovirus__AGM46349
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagccaugcuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacuggaagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcuaccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6553 - RNA, 1623 nt, Artificial Sequence; identical to SEQ ID NO: 6552
  major_capsid_protein__Norovirus__AGM46355

SEQ ID NO: 6554 - RNA, 1623 nt, Artificial Sequence
  major_capsid_protein__Norovirus__AGM46359
augaaaauggcgucgaaugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccgaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagccauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuucaagcagucguaacuacacaaugaauuuggccucccaaaauuggagcaguuacgauccaacagaagaaaucccagccccucuaggaacuccagauuucguggggaagauucaagguguacucacccaaaccacaaggacagauggcucgacccgcggccacaaagcuacaguguacacugggagcgccgacuuuucuccaaaacuggguagaguucaauuugacacugacacagacaaugauuuugaaacuaaccaaaacacaaaguucaccccagucgguguuauccaggaugguaguacuaccuaccgaaaugaaccccaacaaugggugcucccaaguuacucaggcagaaacacucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaacccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacgugcauuauaa

SEQ ID NO: 6555 - RNA, 1623 nt, Artificial Sequence
  major_capsid_protein__Norovirus__AGM46362
augaagauggcgucgagugacgccaacccaucugaugggucuacagccaaccucgucccagaggucaacaaugagguuauggcuuuggagcccguaguuggugccgccauugcggcaccuguagcgggccaacaaaauguaauugaccccuggauuagaaacaauuucguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaauugauagccauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuucaagcagucguaacuacacaaugaauuuggccucccaaaauuggagcaguuacgauccaacagaagaaaucccagccccucuaggaacuccagauuucguggggaagauucaagguguacucacccaaaccacaaggacagauggcucgacccgcggccacaaagcuacaguguacacugggagcgccgacuuuucuccaaaacuggguagaguucaauuugacacugacacagacaaugauuuugaaacuaaccaaaacacaaaguucaccccagucgguguuauccaggaugguaguacuaccuaccgaaaugaaccccaacaaugggugcucccaaguuacucaggcagaaacacucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaacccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacgugcauuauaa

SEQ ID NO: 6556 - RNA, 1623 nt, Artificial Sequence
  major_capsid_protein__Norovirus__AGM46366
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacagucucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacggauggcguacuccuagguacuacccaacugucccccgucaacaucugcaccuucagaggggaugucacccauauuccaggcagucgcaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguuuuacacacuugcccccaugggaaaugggacggggaguagacgugcauuauaa

SEQ ID NO: 6557 - RNA, 1623 nt, Artificial Sequence
  major_capsid_protein__Norovirus__AGM46367
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacagucucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacggauggcguacuccuagguacuacccaacugucccccgucaacaucugcaccuucagaggggaugucacccauauuccaggcagucgcaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggugucauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6558 - RNA, 1623 nt, Artificial Sequence
  major_capsid_protein__Norovirus__AGM46370
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaguccucgcggggaacgcguucaccgccggaaaaaucauauuugcagcagucccaccaaauuucccaacugaaggcuugagccccagccaggucacuauguuuccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugacuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcagaugcacgacugauggcguacuccuagguaccacucaacugucuccugucaacaucugcaccuucagaggggaugucacccauaucacagguagucguaacuacacaaugaauuuggcuacucaaaauuggaacaguuaugacccaacagaagaaaucccagccccccuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugacacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugccugcucccccaggaaugggugcaguauuucuaucaagaggcagccccagcacaaucugauguggcucugcuaagauuugugaauccagacacagguaggguuuuguuugaguguaaacuucauaaaucaggcuauguuacaguggcucacaccggucaacaugauuugguuaucccccccaaugguuauuuuagauuugauuccugggucaaccaguucuacacacuugcccccaugggaaauggaacggggcguagacgugcauuauaa

SEQ ID NO: 6559 - RNA, 1623 nt, Artificial Sequence
  major_capsid_protein__Norovirus__AGM46375
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaguccucgcggggaacgcguucaccgccggaaaaaucauauuugcagcagucccaccaaauuucccaacugaaggcuugagccccagccaggucacuauguuuccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugacuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcagaugcacgacugauggcgugcuccuagguaccacucaacugucuccugucaacaucugcaccuucagaggggaugucacccauaucacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugacacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugccugcucccccaggaaugggugcaauauuucuaccaggaggcagccccagcacaaucugauguggcucugcuaagauuugugaauccagacacagguaggguuuuguuugaguguaaacuucauaaaucaggcuauguuacaguggcucacaccggucaacaugauuugguuaucccccccaaugguuauuuuagauuugauuccugggucaaccaguucuacacacuugcccccaugggaaauggaacggggcguagacgugcauuauaa

SEQ ID NO: 6560 - RNA, 1623 nt, Artificial Sequence
  major_capsid_protein__Norovirus__AGM46377
augaagauggcgucgagugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguguccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucaccauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugacuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcagaugcacgacugauggcgugcuccuagguaccacucaacugucuccugucaacaucugcaccuucagaggggaugucacccauaucacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugacacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugccugcucccccaggaaugggugcaguauuucuaucaagaggcagccccagcacaaucugauguggcucugcuaagauuugugaauccagacacagguaggguuuuguuugaguguaaacuucauaaaucaggcuauguuacaguggcucacaccggucaacaugauuugguuaucccccccaaugguuauuuuagauuugauuccugggucaaccaguucuacacacuugcccccaugggaaauggaacggggcguagacgugcauuauaa

SEQ ID NO: 6561 - RNA, 1623 nt, Artificial Sequence; identical to SEQ ID NO: 6559
  major_capsid_protein__Norovirus__AGM46379

SEQ ID NO: 6562 - RNA, 1623 nt, Artificial Sequence; identical to SEQ ID NO: 6559
  major_capsid_protein__Norovirus__AGM46384

SEQ ID NO: 6563 - RNA, 1623 nt, Artificial Sequence
  major_capsid_protein__Norovirus__AGM46386
augaagauggggucgaaugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaccccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagccaugcuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacgugcauuauaa

SEQ ID NO: 6564 - RNA, 1623 nt, Artificial Sequence
  major_capsid_protein__Norovirus__AGM46388
augaagauggggucgaaugacgccaacccaucugauggguccacagccaaccucgucccagaggucaacaaugagguuauggcuuuggagcccguuguuggugccgccauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuucacaguuucuugucggguacucacgagaccaucccccgauuuugauuucauauuucuagugccacccacaguugaaucaagaacuaaaccauucucugucccaauuuuaacuguugaggagaugaccaauucaagauuccccauuccuuuggaaaagcuguucacgggccccagcagugccuuuguuguucaaccacaaaacggcaggugcacgacugauggcgugcuccuggguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggccacaaagcuacaguguacacugggagcgccgacuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggcgagcaacuucucuucuucagauccacuaugcccggaugcagcggguaccccaacauggauuuggacugucugcuuccccaggaaugggugcaguauuucuaucaagaggcagccccagcacaaucugauguggcucugcuaagauuugugaauccagacacagguaggguuuuguuugaguguaagcuucauaaaucaggcuauguuacuguggcucacaccggccaacaugauuugguuaucccccccaaugguuauuucagauuugauuccugggucaaccaguucuacacacuugcccccaugggaaauggaacggggcguagacgugcauuauaa

SEQ ID NO: 6565 - RNA, 1623 nt, Artificial Sequence
  major_capsid_protein__Norovirus__AGM46392
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuaggaacgcuccaggugaaauacuguggagcgcgccccuaggcccugauuugaauccuuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuuuacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgauugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuugcuccaaaacuggguagaguucaauuugccacugacacagacaaugauuuugaugcuaaccaaaacacaaaguucaccccagucggugucauccaggaugguaauacugcccaccgaaaugaaccccaacaaugggugcucccaaguuacucagguagaaauagucacaaugugcaccuggcccccgcuguagcccccacuuuuccgggugagcaauuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuucagauuugauuccugggucaaccaguucuacacacuugcccccaugggaaauggaacggggcguagacgugcauuauaa

SEQ ID NO: 6566 - RNA, 1623 nt, Artificial Sequence
  major_capsid_protein__Norovirus__AGM46395
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuaggaacgcuccaggugaaauacuguggagcgcgccccuaggcccugauuugaauccuuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuucacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucagguagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuuuagauuugauuccugggucaaccaguucuacacacuugcccccaugggaaauggaacggggcguagacgugcauuauaa

SEQ ID NO: 6567 - RNA, 1623 nt, Artificial Sequence
  major_capsid_protein__Norovirus__AGM46398
augaagauggcgucgagugacgccaacccaucugauggguccaaagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagccauguuguacacaccacuuagggcuaauaaugccggggacgaugucuucacagucucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacggauggcguacuccuagguacuacccaacugucccccgucaacaucugcaccuucagaggggaugucacccauauuccaggcagucgcaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguuuuacacacuugcccccaugggaaaugggacggggaguagacgugcauuauaa

SEQ ID NO: 6568 - RNA, 1623 nt, Artificial Sequence
  major_capsid_protein__Norovirus__AGM46401
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagccauguuguacacaccacuuagggcuaauaaugccggggacgaugucuucacagucucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacggauggcguacuccuagguacuacccaacugucccccgucaacaucugcaccuucagaggggaugucacccauauuccaggcagucgcaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccugggucaaucaguucuacacacuugcccccaugggaaaugggacggggcguagacgugcauuauaa

SEQ ID NO: 6569 - RNA, 1623 nt, Artificial Sequence
  major_capsid_protein__Norovirus__AGM46403
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucucauuuggccagaauguacaauggcuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagccauguuguacacaccacuuagggcuaauaaugccggggacgaugucuucacagucucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacggauggcguacuccuagguacuacccaacugucccccgucaacaucugcaccuucagaggggaugucacccauauuccaggcagucgcaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccugggucaaucaguucuacacacuugcccccaugggaaaugggacggggcguagacgugcauuauaa

SEQ ID NO: 6570 - RNA, 1623 nt, Artificial Sequence
  major_capsid_protein__Norovirus__AGM46407
augaagauggcgucaagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcguccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguuaauccccuuacccgauguuaggaauaauuucuaccauuauaaucaaucaaaugaccccaccaucaaauugauagccaugcuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacuggaagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcuaccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6571 - RNA, 1623 nt, Artificial Sequence
  major_capsid_protein__Norovirus__AGM46409
augaaaauggcgucgaaugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcucuauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagaaauguccagaauguacaccuagccccugcuguggcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguagcucuauugagauuugugaauccagacacagguaggguccuguuugaguguaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6572 - RNA, 1623 nt, Artificial Sequence
  major_capsid_protein__Norovirus__AGM46413
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagaaauguccagaauguacaccuagccccugcuguggcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguagcucuauugagauuugugaauccagacacagguaggguccuguuugaguguaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6573 - RNA, 1623 nt, Artificial Sequence
  major_capsid_protein__Norovirus__AGM46415
augaagauggcgucgagugacgccaacccaucugauggguccgcagccaaccucgucccagaggucaacaaugagguuauggcuuuggaacccguugucggugccgcuauugcggcgccuguagcgggccaacaaaauguaauugaccccuggauuagaaauaauuuuguacaagccccugguggggaguuuacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaacaacuucuaucauuauaaucagucaaaugauucuaccauuaaauugauagcaaugcuguauacaccacuuagggcuaauaacgcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucauaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaacccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacgugcuuuauaa

SEQ ID NO: 6574 - RNA, 1623 nt, Artificial Sequence
  major_capsid_protein__Norovirus__AGM46419
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguuuacaguguccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauuccaccauuaaauugauagcaaugcuguauacaccacuuagggcuaauaaugcuggggaagaugucuucacagucucuugucgaguucucacgagaccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaauuccagauuuugugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacagguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6575 - RNA, 1623 nt, Artificial Sequence
  major_capsid_protein__Norovirus__AGM46421
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaaugguuaugcagguggcuucgaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaacaaugcuggggaagaugucuucacagucucuugucgaguucucacaaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggacccagcagugccuuuguuguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggaguacccccuuuacuccaaagcugggcaguguccaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacagguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguaggcgugcuuuauaa

SEQ ID NO: 6576 - RNA, 1623 nt, Artificial Sequence
  major_capsid_protein__Norovirus__AGM46425
augaagauggcgucgagugacgccaacccaucugauggguccgcagccaaccucgucccagaggucaacaaugagguuauggcuuuggaacccguugucggugccgcuauugcggcgccuguagcgggccaacaaaauguaauugaccccuggauuagaaauaauuuuguacaagccccugguggggaguuuacaguguccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaacaacuucuaucauuauaaucagucaaaugauucuaccauuaaauugauagcaaugcuguauacgccgcuuagggcuaauaacgcuggggaagaugucuuuacagucucuugucgaguucucacgaggccauccccugauuuugauuuuauauuuuuagugccaccuacagucgagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguguuuacacaaugaauuuggccucucuaaauuggaacaauuaugacccaacagaagaaauuccagccccucuaggaacuccagauuuugugggaaagauccaaggugugcucacucaaaccacaaaggaagacggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugccccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaacccagacacggguaggguccuguuugagugcaaacuucauaaaucaggcuaugucacaguggcucacaccggucagcaugauuuggucaucccccccaaugguuauuuuagguuugauuccuggguuaaucaauuuuacacacuugcccccaugggaaauggaacggggcguagacgugcuuuauaa

SEQ ID NO: 6577 - RNA, 1623 nt, Artificial Sequence
  major_capsid_protein__Norovirus__AGM46427
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgccccuaggcccugaucugaaucccuaccuaucucauuuggccagaauguauaaugguuaugcagguggcuucgaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaacaacuucuaucauuauaaucagucaaaugauucuaccauuaaauugauagcaaugcuguacacgccgcuuagggcuaauaacgcuggggaagaugucuuuacagucucuugucgaguucucacgaggccauccccugauuuugauuuuauauuuuuagugccaccuacagucgagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugccuccugucaacaucugcaccuucagaggggaugucacccacauugcagguucucguguuuacacaaugaauuuggccucucuaaauuggaacaauuaugacccaacagaagaaauuccagccccucuaggaacuccagacuuugugggaaagauccaaggugugcucacucaaaccacaaaggaagacggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugccccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccagcacaaucugauguggcucuauugagauuugugaauccagacacagguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguaggcgugcuuuauaa

SEQ ID NO: 6578 - RNA, 1623 nt, Artificial Sequence
  major_capsid_protein__Norovirus__AGM46431
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcagguaauccucgcggggaacgcguucaccgccggaaaaauuauauuugcagcagucccaccaaauuucccgacugaaggcuugagucccagccaggucacuauguucccccacauaauaguggauguuaggcaauuggaaccuguguugaucccccuaccugauguuaggaauaacuucuaucauuauaaucaaucaaaugauucuaccauuaaauugauagccaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuugacuguugaggaaaugaccaauucaagauucccuauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauucaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuagucaucccccccaaugguuauuuuagguuugauuccuggguuaaucaauucuacacacuugcccccaugggaaauggaacggggcguagacgugcuuuauaa

SEQ ID NO: 6579 - RNA, 1671 nt, Artificial Sequence
  major_capsid_protein__Norovirus__AGN11430
augaagauggcgucgagugacgcugcuccaucuacggauggugcgggcaaccucguuccagagagucaacaagagguguugccccucgccccaguugcaggcgcugcguuagcggcaccugugguggggcaaacaaauauaauugaccccuggauuaaagaaaauuuuguccaagccccccagggugaguuuacugucucaccuaaaaauucuccuggugaaauuuuagucaauuuggaauugggacccaaacucaaccccuaucuagaccaccuuucacgcauguacaauucauaugcugguggcauagaugucauggugguguuggcgggcaacgccuucacagccggcaagguuuuaauagcagcuauccccccaaauuucccaguggaagugguguccgcuucacaagccacucaauucccccaugugauuauagauguuaggacacuugacccugugcggcucccccucccggaugugcgauccacguucuuccauuacacuaaugauacugaaccaaagaugagguuagucauuuggcuuuacaccccacuuagaacuaauggcaguggugaugauucuuucaccgucucugggcgcauacucacaaggcccucccaggacuuugaguuugcuuuccuuauccccccaacaguggaaacaaagacaacccccuuuucagugccaggcuucucggugcaggaaauguccaacucaagguggccagcugccaucucugcaauggucguccgugggaaugagccccaagucguucaguuccagaaugguagggcccacuuggaugguauguugcuugguacgacaccugugucgcccaauuacauagcauccuaccgaggcaucuccacuggcaacucucguucugcuuccccugaggccgacgagagggccguugguagcuuugauguguggguccgccuacaagaaccugauggccagcccuaugacaucuuugguaagcagccagccccaauuggcaccccugauuucaaggccgugauaguuggcuuugcagcuaggccccucacauccggguccuacgcaaaugaagcguauguuaacaccacagccaguaacuacgccccagccacugguaauaugcgcuucacagucaggaacggcgggaccgggcacacaucugcaaacaaauauugggaguucaaaucauuugguguugaaggagaaaggcacacuggcauccaguaccaggaguaugagcuucccgauuauucuggucaaguugcuuccaaccauaaucuggcccccccuguagccccacgcaugccuggugagucacuauugcuuuuccaaucaaauaugccugugugggacgaugggcauggagaguccacacccaagaagauucauugccuauugccacaggaguuuauuggccauuucuuugacaagcaagcccccucucuaggugaugcugcacuacuuagguaugucaaccaggagacaaauagaguguuguuugaguguaaacuuuauagggauggcuacaucacaguugcugcaucaucaggauuauuagauuuccccuuggauggcuucuuuagguuugauucuuggguuaguucuuucuacauuuuaucccccgugggaagcggccaaggccgcagggguagagugagguuucaauaa

SEQ ID NO: 6580 - RNA, 1647 nt, Artificial Sequence
  major_capsid_protein__Norovirus__AGO64038
augaagauggcgucgaaugacgccacuccaucuaaugauggugccgccggccucgucccagagaucaacaaugaggcaauggcgcuagauccaguggcgggugcagcgauagcagcgccccucacuggucagcaaaauauaauugaucccuggauuaugaauaauuuugugcaagcaccugguggugaguuuacaguauccccuaggaauuccccuggugaagugcuucuuaauuuagaauugggcccagaaauaaaucccuauuuggcccaucuugcuagaauguauaaugguuaugcagguggauuugaagugcagguaguccuagcuggaaaugcguuuacagcaggaaagauaaucuuugcagcuauacccccuaacuuuccaauugauaaucuaagcgcagcacagaucacaaugugcccacaugugauuguggaugucagacaguuggaaccggucaaccucccgaugccugauguucgcaacaacuucuuucauuacaaucaagggucugauccgaaauugcgcuuaauugcaaugcuguauacaccucuuagggcaaacaauucuggggaugauguuuuuacugugucuuguagagugcugacuagaccuagcccugacuuuucauuuaauuuccuugugccacccacuguggagucaaagacaaaacccuucacucuccccauucugacuaucucugaaauguccaauucuagguuuccagugccgauugauucucugcacaccagcccaacugagaauauuguuguccagugccaaaaugggcgcgucacucuugauggugaguugaugggcaccacccaacucuuaccuagucaaaucugugcuuucaggggcgugcucaccagaucaacaagcagaaccagugaucaggccgacacagcaaccccuagguuguuuaauuauuauuggcacauacaauuggauaaucuaaaugggacuccuuaugauccugcagaagacauaccagguccccuagggacaccagauuuucggggcaaagucuuuggcguggccagccagagaaaucccgacagcacaacuagagcacaugaagcaaagguggacacaacagcuggccguuucaccccaaaacuaggcucauuagagauauccacugaaucugaugacuuugaucaaaaccaaccaacaagauucaccccaguuggcauugggguugacaaugaggcagacuuucaacaauggucuuuacccgacuauucuggucaguucacccacaacaugaacuuagccccagcuguugcucccaacuucccuggugagcagcuccuuuucuuccgcucacaguuaccauccucuggugggcgauccaacgggauucuagacugccuggucccccaagaauggguucagcacuucuaccaagaaucggcccccgcccaaacucaaguggcccugguuagguaugucaacccugacacugguagaguauuauuugaggccaagcugcacaaauuagguuucaugacuauagcuaagaauggugacucuccaauaacugucccuccaaauggauauuuuagguuugaaucuugggugaacccauuuuauacacuugcccccaugggaacugggaaugggcguaggaggauucaauaa

SEQ ID NO: 6581 - RNA, 1623 nt, Artificial Sequence
  major_capsid_protein__Norovirus__AGO64040
augaagauggcgucgaaugacgcagcuccaucuaaugauggugcagcaggccucguaccagagaucaacaaugaggucaugccccuugaacccguggcuggugcaucgccggcgacaccaguugucgggcaacaaaacauaauugaucccuggauaagaaauaauuuugugcaggcuccugcaggugaguuuacaguuuccccuagaaauucuccuggugaaaucuugcuugauuuggaauugggaccagaauugaaccccuaucuagcucaucuggcccgcauguauaacgggcacgcugguggcauggaagugcaaauuguguuggcugggaaugcguucacagcuggcaagaucauauuugcugccauuccuccaggguucccacaugaaaaucuuucaccuucacaaauuacaaugugcccccauguuauaauugauguuagacaauuagaaccaguccuauugccuaugccagacaucagaaauaauuucuuccauuacaaucaggguaaugauccaaaauugagauugauagcuaugcucuauaccccuuuaagggccaauaauucuggugaugauguguuuacagucucuugcaggguccucacuaaaccgucaccugauuuugaauuuacauuucuaguucccccuacaguugaaucuaaaaccaagcaguuuacauugcccauucuuaaaauaucagagaugaccaauucaagauucccagugccaguagaaaugauguacacagcuaggaaugagaaccaaguuguccagccacagaaugguagggucacgcucgauggugagcuauugggcaccacgcccuuguugggcaucgacauaugcaaauucaagggagagguuauagccaagaauagagaugauagauccuauagaauggacauggaaauuaccaacacugauggcaccccaaucgaccccacagaggacacgccuggucccauugguucaccugauuuucgaggcauacucuuuggcguugccagccaacgcaacaagaaugagcaaaacccugccacaagaggccaugaagccaauauuaacacugguggaaaucaauaugccccuaaauuggcccaagugaaauucuucucagaguccgaugauuuugaugagcaucagcccacaguuuucaccccaguugguguggcaggcgacgauucccacccuuucagacaguggguccugccucgauacgguggacaucucaccaauaacacccacuuggcuccagcaguggccccucuauucccaggugagcagauucuauucuuuagaucacaaauaccuagcucaggcggcuuugaauuggguuacauggacugccuugucccacaagaguggguccaacacuucuaucaagaagcugcuacagcucagucugauguggcacucauaagguucaucaacccagacacugguagaguccucuuugaggccaagcugcacaagcaaggcuuuauaacuguggcucacacuggugacaacccaauagucaugccaccaaauggguacuuuagauuugaagcuuggguuaaucaguuuuacucacucgcccccgugggaacugggaaugggcguaggaggguccaauaa

SEQ ID NO: 6582 - RNA, 1608 nt, Artificial Sequence
  major_capsid_protein__Norovirus__AGO64042
augaagauggcgucgaaugacgccgcuccaucuaaugauggugcagccggucucguaccagaggcuaacaaugagaccauggcacuugaaccgguggcuggggcuucaauagccgccccgcucacuggccaaaauaauguuauagaccccuggauuagauuaaauuuugugcaggcucccaauggggaauuuacgguuucaccccguaacucuccuggggaaauccuacuaaauuuggaauuaggccccgaacuaaauccauauuuggcacaccuuucuagaauguacaaugguuaugcaggugggguugaggugcaaguacuacuggcugggaaugcguucacagcuggaaaacuagucuucgccgcaguucccccccauuucccauuagaaaauauaagcccuggccaaauaacuauguucccccauguaauuauugauguuaggacuuuagaaccaguucuguuaccccucccugauguuaggaauagcuucuuucauuauaaccagcagaaugaaccgaggaugaggcuuguagcuaugcuuuauacuccucuuagaucuaaugguucuggugaugauguauuuacugucuccuguagggugcucacccgaccuuccccugauuuugauuucaacuauuugguucccccuacuguugagucuaaaacuaagcccuuuacacuccccauuuugacuaugggagaauuaaccaauuccagguucccugugcccauagaugagcucuacaccagccccaaugagaauuugguggugcaaccccagaacgggaggugcgcgcuggacggggaguugcagggcacgacucagcuccuccccacggcgauuugcucguucaggggccgggucaaccagaaagugaguggggagaaccauguuuggaauaugcaggucaccaacaucaacgggacuccuuuugauccaacagaagaugucccagccccuuuaggcacuccagacuuuucugguagacucuuugguguuuugagccagagggaccacgacaaugccuguaggagccaugaugcagugauugcaacuaauucuacuaaauucaccccaaaauugggcgcuauacaaauuggcacaugggaagaagaugaugugcacaucaaucaacccaccaaauucacuccaguuggcuuauuugauacugaugauuucaaucagugggcacucccuaacuauucuggugccuuaacacucaauaugggacuggccccaccuguugccccuaccuucccuggugaacaaauucuuuucuuuagaucccauaucccucucaaaggagguguggcagacccagucauugauugucuuuugccucaagaguggauucaacaucucuaccaagagucggccccaucacaaucggauguagcacuaauuagguucacaaauccagacacaggacgcgucuuauuugaagcaaaauuacauaggaguggcuauaucacgguggccaauacuggcaacaggccgauugugguaccagcuaaugguuacuucagauuugacucuuggguuaaucaguucuauucucuugcccccaugggaacugggaacgggcgcagaaggguacaguaa

SEQ ID NO: 6583 - RNA, 1623 nt, Artificial Sequence
  major_capsid_protein__Norovirus__AGS41450
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggaucagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguagauguuaggcaauuggaaccuguguugauucccuuaccugauguuaggaauaacuucuaucacuauaaucagucaaaugauucuaccauuaaauugauagcaaugcuguacacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaauuuuccgggugaacaacuucucuucuucagguccacuaugcccggaugcagcggguaucccaacacggauuuggauugccuacucccccaggagugggugcagcacuucuaccaagaggcagcuccagcacaaucugauguggcucuauugagauuugugaauccagacacggguagggucuuguuugagugcaaacuucauaaaucagguuaugucacaguggcucacaccggccaacaugauuuggucaucccccccaaugguuauuuuagguuugauuccuggguuaaucaauucuauacacucgcccccaugggaaauggaacggggcguagacgugcauuauaa

SEQ ID NO: 6584 - RNA, 1623 nt, Artificial Sequence
  major_capsid_protein__Norovirus__AGT62521
augaugauggcgucuaaggacgccccaacauccccugauggcgccaguggcgccggccagcugguaccggaggcuaauacagcugagcaaauuucaauggacccuguugcgggugcuucaacagcagucgcgacggcuggacaaguuaauaugauugacccauggauuuuuaauaauuuuguccaggcuccccaaggagaauucacuauuuccccuaauaauacccccggugauauuuuauuugauuuacaacuaggaccccaccuuaauccauuucuagcccaccucucacagauguauaaugguugggucggcaauaugcgugugcgcauacuguuggccgggaaugccuuuacagcuggaaagauaaucauuugcuguguccccccugguuuugaugcuagaauacucacaauagcucaagcaacucucuucccacauuuaauugcugauguuaggacucuugagccuguggagcuucccuuggaggaugugcgcaacguucucuaccauaacaguagccaaccgcagccaacaaugcggcugguugcuauguuguacaccccccuccgcacugguggugguuccggaggcacugaugccuuugugguggcgggcagggugcuuacgugccccgcccccgacuuuagcuuucuguuucuuguuccuccuuccguugaacaaaagaccaggguuuuuaguguccccaauauaccccugaaagaccucucaaauucucguguccccgugccuguacagggcauguuuauguccccagaugucaaucagucaguccaguuucagaaugggcgcugccaaauugauggucaacuccagggcaccacuccugucucacucagccaacucugcaagauuagggguaaaacuucuagcaaugcuagggugcucaacuuaagugagguagauggcacacccuuuaucccucuugaaucaccagcgccaguuggcuuucccgacuuaggagguugugacuggcauguaaauuucacuuuccaggcucaagaucaggacccaucucaaagugugaccuuugcaacuaaugaugccagcuuuguccccuaccuagguaguaucuccccucacaaugggggagacuuucaugcaggcgacaucauagguagccuugguuggauuucagccccaucugguaauucacagcuuaauguuugggcaauaccaaaguauggaucuagucucccagaugucacucaccuugccccugcuguguuccccccagguuuuggggaggugauucuauacuucuacucuaccuucccagguucuggacaacccagccaacuucaagucccauguuuguugccucaggaguuuaucacccacuucuguaacgaacaggcucccaucgcuggggaggcugcccuccuucacuacguggacccugauacggggcgaaacuugggggaauucaaacuuuacccugauggguuuaugaccugugucccuaauaguguuaguaguggcccucaaacccuuccuaucaauggagucuuugucuuuguuucauggguaucuagauucuaucaacucaagccugugggaacggccucagcggcuagaaggcuuggacugcggcgcauauaa

SEQ ID NO: 6585 - RNA, 1629 nt, Artificial Sequence
  major_capsid_protein__Norovirus__AGT62523
augaagauggcgucgaaugacgccgcuccaucuacugauggugcagccggccucgugccagaaaguaauaaugaggucauggcucuugagccgguggcuggcgcugccuuggcggcuccaguuacuggccaaacaaauauuauagacccuuggauuagaacaaauuuuguccaggccccuaauggugaauucacuguuucuccacgcaacgccccuggugaagugcuguuaaaucuagaguuggguccagaauuaaauccuuaucuggcacauuuggcaagaauguacaacggguaugccggcggaauggaggugcaggucauguuagcuggaaaugcguuuacagcuggaaaguuggucuucgccgcagucccaccucauuuucccguugaaaaucuuagcccacagcaaaucacaauguuuccccaugugauuauugauguuaggacuuuggaaccuguccuguuaccacucccugauguuagaaauaauuucuuucauuacaaucaaaaggaugacccuaagaugagaauuguggcuaugcucuauacuccccucagaucaaaugguucuggugaugauguauucacaguuucuuguagaguguuaacuaggcccuccccugacuuugauuuuacguauuuggugccaccaacgguggaauccaaaacaaagccauucacacucccaauccuuacauuaggggagaugucuaauucaagauucccagugcccauagaucaaauguacacuagcccuaaugaaguuauuucugugcagugucagaauggcagguguacacuggacggggagcuccaagggacaacacagcuccaggucagugguauuugcgcauucaaaggacaagugaccgcccaccuacaggacaaugaacaucuuuacaaugucaccaucacaaauuugaauggguccccuuuugaccccucugaggacauccccgcuccccuggguguucccgacuuugaagggaggguuuucggugucaucagccaaagagacaauuacaauucuggugggcaaaaccagccugcaaauaggucucaugaugcuguggucccaacuuacacagcucaauacacuccaaaauugggucagauucaaauuggcacguggcagacugaugacauaacagucgaccagccugcuaaauucaccccaguuggccuuagugacacagaccacuuuaaccaaugggugguucccagguaugcuggugcauuaaauuugaacacaaaucuugccccuucuguugcaccgguguucccaggagagcgguugcucuucuuuagaucauacaucccccuuaaaggugguuuuggcaacccagccauugauugccuggugccacaggaguggauacagcacuucuaccaagaggcugcucccucacugagugaggucgcccuugucagguauaucaauccggacacuggucgggcgcuguuugaggccaagcuccacagggcuggcuucaugacagucucgaguaacaccagugccccggugguuguaccugccaauggguacuucagauuugauucuugggugaaccaauuuuauucucuugcccccaugggaacuggcaaugggcguagaaggauucaauaa

SEQ ID NO: 6586 - RNA, 1623 nt, Artificial Sequence
  major_capsid_protein__Norovirus__AGV40221
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuaggaacaauuuuguacaagccccugguggagaguuuacaguauccccuagaaacgcuccaggugaaauacuauggagcgcgcccuuaggcccugaucuaaaucccuaccuuucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacgaugaauuuggcuucucaaaauuggaacaauuaugacccaacagaagaaaucccagccccucuagggacuccagauuuuguggggaaaauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccuggguuaaccaguucuacacgcuugcccccaugggaaauggaacggggcguagacguguaguauaa

SEQ ID NO: 6587 - RNA, 1623 nt, Artificial Sequence
  major_capsid_protein__Norovirus__AGV76553
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacucuggccaacaugauuugguuaucccccccaaugguuauuuuagguuugauuccugggucaaccaguuuuacacgcuugcccccaugggaaauggaacggggcguagacgugcacuauaa

SEQ ID NO: 6588 - RNA, 1623 nt, Artificial Sequence
  major_capsid_protein__Norovirus__AGV76554
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaacggaacggggcguagacgugcacuauaa

SEQ ID NO: 6589 - RNA, 1623 nt, Artificial Sequence; identical to SEQ ID NO: 6588
  major_capsid_protein__Norovirus__AGV76555

SEQ ID NO: 6590 - RNA, 1623 nt, Artificial Sequence
  major_capsid_protein__Norovirus__AGV76556
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaacggaacggggcguagacgugcacuauaa

SEQ ID NO: 6591 - RNA, 1623 nt, Artificial Sequence; identical to SEQ ID NO: 6590
  major_capsid_protein__Norovirus__AGV76557

SEQ ID NO: 6592 - RNA, 1623 nt, Artificial Sequence; identical to SEQ ID NO: 6590
  major_capsid_protein__Norovirus__AGV76558

SEQ ID NO: 6593 - RNA, 1623 nt, Artificial Sequence; identical to SEQ ID NO: 6590
  major_capsid_protein__Norovirus__AGV76559

SEQ ID NO: 6594 - RNA, 1623 nt, Artificial Sequence; identical to SEQ ID NO: 6590
  major_capsid_protein__Norovirus__AGV76560

SEQ ID NO: 6595 - RNA, 1623 nt, Artificial Sequence; identical to SEQ ID NO: 6590
  major_capsid_protein__Norovirus__AGV76561

SEQ ID NO: 6596 - RNA, 1623 nt, Artificial Sequence; identical to SEQ ID NO: 6590
  major_capsid_protein__Norovirus__AGV76562

SEQ ID NO: 6597 - RNA, 1623 nt, Artificial Sequence; identical to SEQ ID NO: 6588
  major_capsid_protein__Norovirus__AGV76563

SEQ ID NO: 6598 - RNA, 1623 nt, Artificial Sequence
  major_capsid_protein__Norovirus__AGV76564
augaagauggcgucgagugacgccaacccaucugauggguccgcagccaaccucguuccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccggaaugaaccccaacagugggugcucccaaguuauucaggcagaaauacuccuaaugugcaccuggccccugcuguagcccccacuuuuccgggugagcaacuucucuucuucagauccaccaugcccggaugcagcggguaccccagcauggauuuggacugucugcucccccaggaaugggugcaguacuucuaccaagaggcagccccagcacaaucugauguggcucugcuaagauuugugaauccagacacagguaggguuuuguuugaguguaagcuccauaaaucaggcuauguuacgguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6599 - RNA, 1623 nt, Artificial Sequence
  major_capsid_protein__Norovirus__AGV76565
augaagauggcgucgagugacgccaacccaucugauggguccgcagccaaccucguuccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6600 - RNA, 1623 nt, Artificial Sequence
  major_capsid_protein__Norovirus__AGV76566
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacgugcacuauaa

SEQ ID NO: 6601 - RNA, 1623 nt, Artificial Sequence
  major_capsid_protein__Norovirus__AGV76567
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccacuauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaacuaugacccaacagaagaaaucccagccccucuagggacuccagauuuuguggggaaaauucaaggugugcucacccaaaccacaagaacagauggcucaacacguggccacaaagcuacaguguacaccgggagcgccgauuuugcuccaaaacuggguagaguucaauuuggaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccagcaugauuugguuaucccccccaaugguuauuuuagguuugauuccugggucaaccaguuuuacacgcuugcccccaugggaaauggaacggggcguagacgugcacuauaa

SEQ ID NO: 6602 - RNA, 1623 nt, Artificial Sequence
  major_capsid_protein__Norovirus__AGV76568
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaauagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuucgauuucauauuucuagugccacccacaguugagucaagaacuaaaccauucucugucccaguuuuaacuguugaggagaugaccaauucaagauuccccauaccuuuggaaaaguuguucacgggucccagcagugccuuuguuguccaaccacaaaacggcaggugcacgacugauggcgugcuccuaggcaccacccaacugucuccugucaacaucuguaccuucagaggagaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6603 - RNA, 1623 nt, Artificial Sequence
  major_capsid_protein__Norovirus__AGV76569
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccagucuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuagggacuccagauuuuguggggaagauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6604 - RNA, 1623 nt, Artificial Sequence
  major_capsid_protein__Norovirus__AGV76570
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaacuuuguacaagccccugguggagaguuuacaguauccccuagaaacgcuccaggugaaauacuauggagcgcgcccuugggcccugaucuaaaccccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcacuacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacaccgggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucccaaugugcaucuggcccccgcuguagcccccacuuuuccgggugagcaacuucucuucuucagauccaccaugcccggaugcagcggguaccccaacauggauuuggauugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6605 - RNA, 1623 nt, Artificial Sequence
  major_capsid_protein__Norovirus__AGV76571
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuguggagcgcgcccuugggcccugaucuaaaucccuaccuaucccauuuggccagaauguacaauggcuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcagcuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacauaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugauacagaccaugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6606 - RNA, 1623 nt, Artificial Sequence
  major_capsid_protein__Norovirus__AGV76572
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgcugggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaagugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccagccacaaaacggcaggugcacgacugauggcgugcuccuaggcaccacccaacugucuccugucaacaucugcacuuucagaggagaugucacccauaucacagguagucguaacuacacaaugaauuuggcuucccaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugauacagaccaugacuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugaacaacuucucuucuucagauccaccaugcccggaugcagcggguaccccaauauggauuuggacugucugcucccucaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacgugcaguauaa

SEQ ID NO: 6607 - RNA, 1623 nt, Artificial Sequence
  major_capsid_protein__Norovirus__AGV76573
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccuguuaacaucugcaccuucagaggagaugucacccauaucacagguagucguaacuacacaaugaauuuggcuucucaaaauuggaacaauuaugacccaacagaagaaauuccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccggaaugaaccccaacagugggugcucccaaguuacucaggcagaaacacucauaaugugcaucuggcucccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagauacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacgugcaguguaa

SEQ ID NO: 6608 - RNA, 1623 nt, Artificial Sequence
  major_capsid_protein__Norovirus__AGV76574
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugaucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 6609 - RNA, 1623 nt, Artificial Sequence
  major_capsid_protein__Norovirus__AGV76575
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagacaaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugaucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauccccccuaaugguuauuuuagguuugauuccugggucaaccaguuuuacacgcuugcccccaugggaaauggaacggggcguagacgugcaguauaa

SEQ ID NO: 6610 - RNA, 1623 nt, Artificial Sequence
  major_capsid_protein__Norovirus__AHA44844
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaauacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 6611 - RNA, 1623 nt, Artificial Sequence
  major_capsid_protein__Norovirus__AHA44847
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucugaaucccuaccuaucccauuuggccagaauguacaaugguuaugcaggugguuuugaagugcagguaauucucgcggggaacgcguucaccgccgggaagaucauauuugcagcagucccaccaaauuucccaacugaaggcuugagccccagccaggucacuauguucccccauauaauaguagauguuaggcaauuagaaccuguguugauucccuuacccgauguuaggaauaauuucuaucauuauaaucaaucaaaugaccccaccauuaaauugauagcaauguuguauacaccacuuagggcuaauaaugcuggggacgaugucuucacaguuucuugccgaguucucacgagaccaucccccgauuuugauuucauauuucuagugccaccuacaguugagucaagaaccaaaccauucucugucccaauuuuaacuguugaggagaugaccaauucaagauuccccauucccuuggagaaguuguucacgggucccagcagugcuuuuguuguucaaccacaaaauggcaggugcacgacugauggcgugcuccuaggcaccacccaacuaucuccugucaacaucugcaccuucagaggggauaucacccauaucacagguagccgcaacuacacaaugaauuuggcuucucaaaauuggaacaauuaugacccaacagaagaaauuccagccccucuaggaacuccagauuuuguggggaagauucaaggugugcucacccaaaccacaagggcagauggcucgacacgcggccacaaagcuauaguguacacugggagcgccgacuuugcuccaaaauuggguagaguucaauuugagacugacacagaccaugauuuugaagcuaaccaaaacacaaaguucaccccagucggugucacccaagaugguagcaccacccaccgaaaugaaccccaacagugggugcucccaaguuauucaggcagaaauacucacaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucauaaaucaggcuauguuacaguggcucacacuggccaacaugauuugguuaucccccccaaugguuauuuuagauuugauuccugggucaaccaguucuacacgcuugcccccaugggaaauggaacggggcgcagacguguaguauaa

SEQ ID NO: 6612 - RNA, 1623 nt, Artificial Sequence
  major_capsid_protein__Norovirus__AHB62404
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaacucaagguuccccauuccuuuggaaaaauuguucacgggccccaguagugccuuugucguucaaccacaaaacggcaggugcacgacugauggcgugcuccuagguaccacccaacugucuccugucaacaucugcaccuucagaggggaugucacccauauuucaggcaguaguaacuacacaaugaauuuggccucccaaaauuggaacaguuacgauccaacagaagaaauuccagccccucuaggaacuccagauuucguggggaagauucaagguguacucacccaaaccacaaggacagauggcucgacccgcggccacaaagcuacaguguacacugggagcgccgacuucucuccaaaacuggguagaguucaauuugccacugacacagacaaugauuuugaaacuaaccaaaacacaaaguucaccccagucgguguuauccaggauggugcuacuacccaccgaaaugaaccccaacaaugggugcucccaaguuacucaggcagaaacacucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaagucaggcuauguuacaguggcucacacuggccaacaugauuugguuaucccccccaaugguuauuuuagauuugauuccugggucaaccaguucuauacacuugcccccaugggaaaugggacggggcguagacgugcauuauaa

SEQ ID NO: 6613 - RNA, 1623 nt, Artificial Sequence
  major_capsid_protein__Norovirus__AHB62406
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaagcuguucacgggucccagcagugccuuuguuguccaaccacaaaacggcaggugcacgacugauggcgugcuccuaggcaccacccaacugucuccugucaacaucugcaccuucagaggagaugucacccauaucacaggcagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccaccuuuccgggugagcaacuucucuucuucagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6614 - RNA, 1623 nt, Artificial Sequence
  major_capsid_protein__Norovirus__AID51515
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcucccaggcaccacccaacugucuccugucaacaucugcaccuucagaggagaugucacccauaucacggguagucguaacuacacaaugaauuuggcuucucaaaauuggaacaauuaugacccaacagaagaaaucccagccccucuaggaacuccagauuuuguggggaagauucaaggcgugcucacccaaaccacaaggucagauggcucaacacguggccacaaagcuacaguguacacugggagcgccgauuuugcuccaaaacuggguagaguccaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggccccugcuguagcccccacuuucccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6615 - RNA, 1623 nt, Artificial Sequence
  major_capsid_protein__Norovirus__AID51517
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucuguuccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccacaucacagguagucguaacuacacaaugaauuuggcuucucaaaauuggagcaauuaugacccaacagaagaaaucccagccccccuaggaacuccagauuuuguggggaagauucaaggcgugcucacccaaaccacaaggacagauggcucaacacgcggccacaaagccacaguguacacugggagcgccgacuuugcuccaaaacuagguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6616 - RNA, 1623 nt, Artificial Sequence
  major_capsid_protein__Norovirus__AID51519
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucuguuccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccacaucacagguagucguaacuacacaaugaauuuggcuucucaaaauuggagcaauuaugacccaacagaagaaaucccagccccccuaggaacuccagauuuuguggggaagauucaaggcgugcucacccaaaccacaaggacagauggcucaacacgcggccacaaagccacaguguacacugggagcgccgacuuugcuccaaaacuagguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucacgcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6617 - RNA, 1623 nt, Artificial Sequence
  major_capsid_protein__Norovirus__AID51522
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuaguaccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccagaccacaaggacagauggcucaacacgcggccacaaagccacaguguacacugggagcgccgacuuugcuccaaaacuggguagaguucaauuugaaacugacacagaccgugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6618 - RNA, 1623 nt, Artificial Sequence; identical to SEQ ID NO: 5216
  major_capsid_protein__Norovirus__AID51531

SEQ ID NO: 6619 - RNA, 1623 nt, Artificial Sequence
  major_capsid_protein__Norovirus__AID51534
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaucccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucaggggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6620 - RNA, 1623 nt, Artificial Sequence
  major_capsid_protein__Norovirus__AIL49840
augaagauggcgucgagugacgccaacccaucugauggguccgcagccaaccucgucccagaggucaacaaugagguuauggcccuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccagcugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccggaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6621 - RNA, 1623 nt, Artificial Sequence
  major_capsid_protein__Norovirus__AIL49843
augaagauggcgucgagugacgccaacccaucugauggguccgcagccaaccucgucccagaggucaacaaugagguuauggcucuggagccguuuguuggugccgccauugcggcaccuguagcgggccaacaaaauguaauugaccccuggaucagaaauaauuuuguacaagccccugguggagaguuuacaguauccccuagaaacgcuccaggugaaauacuauggagcgcgcccuugggcccugaucuaaaucccuaccuaucccaucuggccagaauguacaaugguuaugcaggugguuuugaagugcaaguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugaccuaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaagugaaccccaacagugggugcucccaaguuacucaggcagaaacacucccaaugugcaucuggcccccgcuguagcccccacuuuuccgggugagcaacuucucuucuucagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuaugucacaguggcucacacuggccaacaugauuuggucaucccccccaaugguuauuuuagguuugauuccugggucaaccaguuuuacacgcuugcccccaugggaaauggaacggggcguagacgugcacuauaa

SEQ ID NO: 6622 - RNA, 1623 nt, Artificial Sequence
  major_capsid_protein__Norovirus__AIV99914
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaacguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagaugcuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacagcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccggucccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaacgaaccccaacagugggugcucccaagcuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaaggggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 6623 - RNA, 1635 nt, Artificial Sequence
  major_capsid_protein__Norovirus__AJP13619
auggcgucuaaggacgccccucaaagcgcugauggcgcaagcggcgcaggucaacuggugccggagguuaauacagcugacccuuuacccauggaaccuguggcugggccaacaacagccguagccacugcugggcaaguuaauaugauugaucccuggauuguuaauaacuuuguccagucaccucaaggugaguuuacaauuucccccaauaauacccccggugauauuuuguuugauuuacaauuagguccacaucuaaacccuuucuugucacauuugucccaaauguauaacggcuggguuggaaacaugagaguuaggauucuccuugcugggaaugcauucucagcuggaaagauuauaguuuguuguguccccccuggcuuuacaucuuccucucucaccauagcucaggcuacauuguuuccccaugugauugcugaugugagaacccuugaaccaauagaaaugccucuugaggauguacgcaauguccucuaucacaccaaugauaaucaaccaacaaugcgauuggugugcaugcuguacacgccgcuucgcacugguggggggucugguaauucugauucuuuugugguugcuggcagggugcucacagccccuaguagcgacuuuaguuucuuguuccuugucccgccuaccauagaacagaagacucgggcuuuuacugugccuaacaucccauugcaaacccuguccaauucuagguuuccuucccucauccaggggaugauucugucccccgaugcaucucaagugguccaauuccaaaaugggcguugccuuauagauggucaacucuuaggcacuacacccgcuacaucaggacagcuguucagaguaagaggaaagauaaaucagggugcccgcacacuuaaccucacagagguggaugguaaaccauuuauggcauuugauuccccugcaccugugggguuccccgauuuuggaaaaugugauuggcacaugagaaucagcaaaaccccaaacaacacaagcucaggugaccccaugcgcagugucagcgugcaaaccaaugugcaggguuuugugccacaccugggaaguauacaguuugaugaaguguucaaccacccaacaggugauuacauuggcaccauugaauggauuucccagccaucuacacccccuggaacagauauuaaucugugggagauccccgauuauggaucaucccuuucccaagcagccaaucuggcccccccagucuuccccccuggauuuggugaggcucuuguguacuuuguuucugcuuuuccgggccccaacaaccgcucagccccgaaugauguaccuugucuucuuccucaagaguacauaacccacuuugucagugaacaagccccaacgaugggugacgcagcuuuacugcauuaugucgacccugauaccaacagaaaccuuggggaauucaagcuauacccuggagguuaccucaccuguguaccaaacgggguaggugcugggccucaacagcuuccucuuaauggugucuuucucuuugucucuugggugucucguuuuuaucagcucaagccugugggaacagccaguacggcaagagguaggcuuggagugcgccguauauaa

SEQ ID NO: 6624 - RNA, 1632 nt, Artificial Sequence
  major_capsid_protein__Norovirus__AJP13620
auggcgucuaaggacgccccaacaaacauggauggcaccaguggugccggccagcugguaccagaggcaaacacagcugagccuauaucaauggagcccguggcuggggcaguaacagcugccgcaaccgcuggccaaguuaauaugauugaccccuggauaaugaauaauuaugugcaagccccucaaggugaauucaccauaucgccuaacaacacaccaggugacauuuuguuugauuuacaauuaggcccccaccuuaacccuuucuugucccaucuggcccaaauguauaauggcuggguuggcaauaugaaagugaggguuuuauuggcugguaaugccuucacggcugguaaaauaauuauuagcugcauacccccuggcuuuguugcacaaaacauuucuaucgcucaggcuacuauguucccccaugucauagcugauguuagaguuuuggaacccauugaggugccauuggaagaugugaggaaugugcuguuccauaacaaugauaacacaccaaccaugagguuggugugcauacucuacacccccuugcgagccagugguagcucgucuggaacugaccccuuugugauugcugggcgugucuuaacaugcccgagcccugauuuuagcuuuuuguuuuuggucccccccaauguagaacaaaagacuaaaccuuuuagugucccaaaucuuccauugaauacccuuucaaauucgagagucccuucucuaauuaaaucaaugaugguauccagggaccaugggcagaugguucaguuucaaaaugguagggucacucuagaugggcaacugcaaggcaccacgcccacaucagcuagccagcugugcaaaaucagaggcagugucuuccaugcuaauggugggaauggguauaaccugacagaacuggaugggagcccauaccaugcauuugagagccccgcaccaauaggauuuccagaucuaggugaaugugacuggcacauggaggcuucuccuaccacccaauucaauacuggcgauguuauaaaacaaauuaaugucaaacaagaaucagcauuugccccccaccuugguacuauacaggcagacggccugagugaugugagugucaacaccaacaugauagcuaaauuaggaugggugucacccgucagugauggacacaaaagagaugucgacccgugggucaucccacgcuaugggucgacuuugacugaggccgcccaauuagccccuccaauauaucccccagguuuuggugaggccauuguguuuuucaugucagauuuuccuauugcccaugguaccaauggcuugagugugccuuguaccauaccccaagaguucgucacucauuuugucaaugaacaggccccuacuagaggggaagcagcccuauuacauuauuuggacccugacacucauaggaaucuuggugaauuuaaauuauauccugauggcuucaugacgugugugccuaauaccagcggcacugguccacaaacucuuccaaucaauggugucuuuguuuuuguguccugggucuccagauuuuaucaauuaaagccugugggaacagccggcccggcucguaggcuuggcaucagaagaucauaa

SEQ ID NO: 6625 - RNA, 1647 nt, Artificial Sequence
  major_capsid_protein__Norovirus__AJP13621
augaagauggcgucgaaugacgccgcuccaucuaaugauggugccgccggccucgucccagagaucaacaaugaggcaauggcgcuagagccgguggcgggugcagcgauagcagcaccccucacuggucagcaaaauauaauugaucccuggauuaugaauaauuuugugcaagcaccugguggugaguuuacaguauccccuagaaauuccccuggugaaguucuucuuaauuuggaauuggguccagaaauaaaucccuauuuggcccaucuugcuagaauguacaaugguuaugcagguggauuugaagugcaggugguccuagcuggaaaugcguuuacagcaggaaagauaaucuuugcagcuauucccccuaauuuuccaauugauaaucuaagugcagcacagaucacaauguguccacaugugauuguggaugucagacagcuggaaccagucaaccucccgaugccugacguucgcaauaacuucuuucauuacaaucaagggucugauucgagauugcgccuaauugcaaugcuauauacgccucuuagggcaaauaauucuggggaugauguuuuuacugugucuugcagagugcuaacuagaccuaguccugacuucucauuuaauuuccuuguaccaccuacuguggagucaaagacaaaacccuuuucccucccuauucugacuaucucugaaauguccaauucuagguucccaguaccaauugauucucugcacaccagcccuacugagaacauuguuguccagugucagaauggacgcgucacccuugauggugaguugaugggcaccacccaacucuuaccuagccaaaucuguacuuucaggggcgugcucaccagaucaacaagcagggccagugaccaggccgauacagcaaccccuagauuguuuaauuauuauuggcauauacaauuggauaaucuaaauggaacuccuuaugacccugcagaagauauaccaggcccccuagggacaccagauuuccggggcaaagucuuuggcguggccagccagagaaauccugauagcacgacuagggcacaugaagcaaagauagacacaacaucuggccguuucaccccaaaacuaggcucauuagagauuuccacugagucugaugauuuugaucaaaacaaaccaacaagauucaccccaguuggcauugggguugaccaugaggcagacuuucaacaaugggcucuucccgacuaugcuggccaguucacccacaacaugaacuuagccccagcuguugcucccaacuucccuggugagcagcuccuuuucuuccgcucacaguuaccaucuucuggugggcgauccaacgggauucuagacugccuggucccccaagaguggguacagcauuucuaccaagaaucagcccccucccaaucucaaguggcccugguuagguauaucaacccugacacuggcagaguguuauuugaggccaagcugcacaaauuagguuucauaacuauagccaagaauggugacucuccaauaacugucccuccaaauggauacuuuagguuugaaucuugggugaaccccuuuuauacacuugcccccaugggaacugggaaugggcguagaaggauucaauaa

SEQ ID NO: 6626 - RNA, 1653 nt, Artificial Sequence
  major_capsid_protein__Norovirus__AJP13622
augaagauggcgucgaaugacgccgcuccaucaaaugauggugcugccaaccucguaccagaggccaacaaugagguuauggcacuugaaccgguggugggagcuucaaucgcagcuccuguugucggucagcagaauauaauugaccccuggauuagagaaaauuuuguucaagcaccacagggcgaguuuacuguuucaccaaggaacucgccuggugagaugcuucuaaaucuugaauugggcccagaacuuaaccccuauuugagucauuugucccgcauguacaauggguaugcugguggcaugcagguucaggugguccuagcugggaaugcguucacagcugggaagaucaucuuugccgcugugccaccacacuucccuguggauaacaucagugcagcccagauaacuauguguccccaugugauuguugaugugagacagcuugaaccaguacuucuaccccuccccgauauaaggaacagguucuuccauuacaaccaggaaaacaccccccggaugagacucguggccaugcucuacacgccucugagggcuaauuccggggaggauguguucacuguauccuguagaguucugacucgccccgcuccagauuuugaauucacauuuuuaguuccaccaacuguugaaucaaaaacaaaacccuuuacucuaccuauucuaacccuuggugaguugucuaauucccguuucccugcugccauagauaugcuuuacacugaucccaaugaaucaauaguuguucaaccccaaaaugguagauguacccuugauggcacguugcaaggcacaacacaauuggucccaacacagauuugugccuuuagagguacccugaucagccagacugcgagagcggccgauucaacagauuccccccagagagcccgugaucacccguugcacguccaggucaagaaccuagauggcacacaguaugauccaacagaugacauuccugcaguccuuggggcuauugacuucaaagguacaguguucggaguggcaagucagagggacgucucugggacacaagaacagggccauuaugccacccgggcucaugaagcacacauugacacaacugacccaaaguaugcaccuaaauuaggcacaauucucaucaaaucugaaucuacugacuucaccacaaaucagccuauuagguucacuccagugggcaugggugacaacaauuggagacagugggaauugccugacuauucugguagauugacucuaaacaugaaccuugccccugcuguuuccccauccuucccuggugaacgaauccuuuucuuuaggucuauagugccaucagcuggaggcuuugggucuggcuauauagacugucucauaccccaggaaugggugcaacacuucuaccaggaggcagcuccuucacagucugcuguugcacugguuagguaugucaaccccgacacugggcguaacaucuuugaggccaagcugcacagagaaggguuccucaccguggccaauucuggaaauaaucccauugugguucccccuaaugguuauuuuagauuugaggcuuggguuaaucaauucuauacacuugcccccaugggaucuggacaggggcguagaagagcucaguaa

SEQ ID NO: 6627 - RNA, 1614 nt, Artificial Sequence
  major_capsid_protein__Norovirus__AJP13623
augaagauggcgucgaaugacgccgcuccaucuaaugauggugcagccggucucguaccagaggucaacaaugagaccauggcccuugaaccgguggcuggggcuucaauagccgccccacucaccggucaaaauaauguuauagaccccuggauuagauuaaacuuugugcaggcucccaauggagaguuuacaguuucaccccgcaauucgccuggggaaguccugcuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuauaaucagcaaaacgaaccaaggaugaggcuuguggcaaugcucuauaccccccuuagaucuaaugguucuggugaugauguauuuacugucucauguagagugcuuacucgacccucuccugauuuugauuucaauuauuugguacccccuacaguugaaucuaaaacuaaacccuucacacucccuaucuugaccauaggggaguuaaccaauuccagauucccugugccuauagaugaacucuauacuagccccaaugagaguuuggugguacaaccccagaacgggagaugugcgcuggacggggaguugcaggguacuacucagcuccuccccacggcgaucugcucguucaggggucggauuaaucagaaagugaguggagauaaccauguuuggaauaugcaagucaccaacauuaacggaaccccuuuugauccaacagaggauguuccagcuccucuagguacaccagacuuuucuggcaagcucuuuggcgucuuaagccagagggaccaugauaaugccuguaggagccaugaugcagugauugcaacugauucugcuaaauuuaccccaaaauugggcgcuauacaaauuggcacaugggaagaagaugauguacacaucaaccaacccaccaaguuuacuccaguuggcuuguucgaaagagaagguuuuaaucaguggacacucccuaacuauucuggagccuuaacacucaauaugggguuggcccccccuguggcccccacauuuccuggugagcaaauucuuuucuucagaucccacauuccucucaaaggagguguggcagacccaguuauugauugucucuugccccaagaguggauccaacaccuuuaccaggagucagccccuucacaaacagauguagcacugaucagauucacaaauccagacacagggcguguccuauuugaagcaaaauugcacaggaguggcuacaucacaguggccaauacugguagcagaccaauuguggugccagcuaaugguuacuucagguuugacucuuggguuaaucaguuuuauucucucgcccccaugggaacugggaaugggcgcagaagggugcagaaaggcuga

SEQ ID NO: 6628 - RNA, 1623 nt, Artificial Sequence
  major_capsid_protein__Norovirus__AJW67354
augaugauggcgucuaaggacgccccaacauccccugauggcgcuaguggcgccggccagcugguaccggaggcuaauacagcugagcaaauuucaauggacccuguugcgggugcuucaacagcagucgcaacggcugggcaaguuaacaugauugacccauggaucuucaacaacuuuguccaagcaccccaaggagaauucacuauuuccccuaauaauacccccggugauauuuuguuugaccuacaauuaggaccccaucuuaacccauuccuagcccaucucucacagauguauaaugguugggucggcaauaugcgugugcgcauauuguuggccgggaacgccuucacagcuggaaagauaaucauuugcuguguccccccugguuuugaugcuagaauacucacaauagcucaagcaacucucuucccacauuugauugcugauguuaggacccuugagccuguagagcuucccuuggaggacguacgcaacguucucuaccacaacaguagccagccacagccaacaaugcggcugguugcuauguuguacaccccccuccgcacugguggugguucuggaggcacugaugccuuugugguggcgggcagggugcuuacgugccccgcccccgacuuuagcuuuuuguuucuuguucccccuuccguugaacaaaagaccagaguuuucaguguccccaacauaccucugaaagaccucucaaauucucgugucccugugccuguacagggcauguuuguguccccggauguuaaucagucaguucaguuucaaaacggacgcugccaaauugauggucaacuccagggcaccaccccagucucgcucagccaacucugcaagauuagggguaaaacuucaagcaaugcuagggugcucaacuuaagugagguagaugguacaccuuucaucccucuugaaucaccagcgccaguagguuuuccugacuuaggaggcugugacuggcacguaaauuuuacuuuccagacucaagaucgggacccaucucaaagugugaccuuugcaaccaaugaugccagcuuuguccccuacuuaggcagugucuccccucacaauggggaagguuuucaagcaggugacaucauagguagccuuggguggauuucagccccgucugauaauucacaauuuaauguuugggcaauaccaaaguauggaucuagucucccagaugucacccaucuugcuccugcuguguuccccccaggcuuuggggaggugauccuauauuucuacucuaccuucccagguucuggacaacccagucaacuucaagucccauguuuguugccucaggaguucaucacccauuucuguaacgaacaggcucccaucgcuggggaggcugcccuccuccacuacguggacccugacacggggcggaacuugggggaauucaaacucuauccugauggguuuaugaccuguguccccaauaguguuagcaguggcccucaaacccuuccuauuaauggagucuuugucuuuguuucauggguguccagauucuaucaacucaagccugugggaacggccucagcggcuagaaggcuuggauugcggcguauauaa

SEQ ID NO: 6629 - RNA, 1644 nt, Artificial Sequence
  major_capsid_protein__Norovirus__AJW67357
augaagauggcgucgaaugacgcugcuccaucgaaugauggugcugccaaccucguaccagaggccaccaaugagguuauggcacuugagccgguggugggagccucaauugccgcuccugucgucggccaacaaaauauaauugaccccuggauuagagaaaauuuuguucaggcaccacagggugaguuuacuguuucaccaaggaacucaccuggugagaugcuucuaaaucuugaauuaggcccugagcucaacccuuaucugagucacuugucccgcauguauaacggcuaugcuggugguaugcagguucaggugguccuagcugggaaugcguucacagcugguaaaaucaucuuugccgccguuccaccacauuuccccguugagaacauuagugcagcccaaaucacaaugugcccccauguaauuguugaugugagacagcuugagccagugcuuuugccccucccugacauaaggaauagauucuuucauuauaaucaggaaaauaccccccggaugagacuuguggcuauguuguauacaccccuuagagcaaauucuggugaggauguguuuacggugucuugcagaguucugacccgcccugcccccgacuuugaguucacguuuuuggugccaccaacuguggaaucaaagacuaagcccuuuacacucccuauucugacucuuggagagcuguccaacuccagauuccccgcuccgauagauauguuguacacugaccccaaugaggcaauuguggugcaaccacaaaauggcaggugcacucuagauggaacacuucaagggaccacccaacugguacccacccaaauuugcuccuucaggggcacacuaauuagccagacgucgaggucugcagauucaacagauucagccccacgggugaggaaccacccucuccacguucagcugaagaaccucgaugggacaccauaugacccaacagaugaggugccagcaguuuugggugccauagauuucaaaggaacuguguuuggggucgcuagccaaagaaacaccacagggaacucuauaggagcaacccgcgcccaugaagugcacauagacaccacaaacccuagauacaccccaaagcuuggcucuguguugauguauucugaaucuagugauuuugacgauggacaacccacccgcuuuacccccauuggcaugggagccgaugauuggcaccaaugggaauugcccgaauauucuggucaccuuacucuuaacaugaauuuggcccccgcaguugccccugcuuucccuggugagcgcauucucuucuucagaucaguggugccgucugcugguggcuauggaucaggucacauagauugccucaucccacaggaguggguucagcauuucuaccaggaggccgcuccaucacaguccgcgguggcucuuaucagauaugucaacccugacacuggaagaaacaucuuugaggcaaaacugcauagagaaggguucgucacuguggcaaauucuggaaacaaccccauaguugugcccccaaaugguuacuuuagguuugaggccugggucaaucaauucuacacacucacccccaugggaacuggacaggggcgcagaagaauccaauaa

SEQ ID NO: 6630 - RNA, 1644 nt, Artificial Sequence
  major_capsid_protein__Norovirus__AJW67359
augaagauggcgucgaaugacgcugcuccaucgaaugauggugcugccaaccucguaccagaggccaccaaugagguuauggcacuugagccgguggugggagccucaauugcugcuccugucgucggccaacaaaauauaauugaccccuggauuagagaaaauuuuguucaggcaccacagggugaguuuacuguuucaccaaggaacucaccuggugagaugcuucuaaaucuugaauuaggcccugagcucaacccuuaucugagucacuugucccgcauguauaacggcuaugcuggugguaugcagguucaggugguccuagcugggaaugcguucacagcugguaaaaucaucuuugccgccgucccaccacauuucccuguugagaacauuagugcagcccaaaucacaaugugcccccauguaauuguugauguaagacagcuugagccagugcuuuugccccucccugacauaaggaauagauucuuucauuauaaucaggaaaauaccccccggaugagacuuguggcuauguuguauacaccccuuagagcaaauucuggugaggauguguuuacggugucuugcagaguccugacccgcccugcccccgacuuugaguucacguuuuuggugccaccaacuguggaaucaaagacuaagcccuuuacacucccuauucugacucuuggagagcuguccaacuccagauuccccgcuccgauagauauguuguacacugaccccaaugaggcaauuguggugcaaccacaaaauggcaggugcacucuagauggaacacuucaagggaccacccaacugguacccacccaaauuugcuccuucaggggcacgcuaauuagccaggcgucgaggucugcagauucaacagauucagccccacgggugaggaaccacccucuccacguucagcugaagaaccucgaugggacaccauaugacccaacagaugaggugccagcaguuuugggugccauagauuucaaaggaacuguguuuggggucgcuagccaaagaaacaccacagggaacucuauaggagcaacccgcgcccaugaagcgcacauagacaccacaaacccuagauacaccccaaagcuuggcucuguguugauguauucugaaucuagugauuuugaugauggacaacccacccgcuuuacccccauuggcaugggagccgaugauuggcaccaaugggaauugcccgaauauucuggucaccuuacucuuaacaugaauuuggcccccgcaguugccccugcuuucccuggugagcgcauucucuucuucagaucaguggugccgucugcugguggcuauggaucaggucacauagauugccucaucccacaggaguggguucagcauuucuaccaggaggccgcuccaucacaguccgcgguggcucuuaucagauaugucaacccugacacuggaagaaacaucuuugaggcaaaacugcauagagaaggguucaucacuguggcaaauucuggaaacaaccccauaguugugcccccaaaugguuacuuuagguuugaggccugggucaaucaauucuacacacucacccccaugggaacuggacaggggcgcagaagaguccaauaa

SEQ ID NO: 6631 - RNA, 1644 nt, Artificial Sequence
  major_capsid_protein__Norovirus__AJW67362
augaagauggcgucgaaugacgcugcuccaucgaaugauggugcugccaaccucguaccagaggccaccaaugagguuauggcacuugagccgguggugggagccucaauugcugcuccugucgucggccaacaaaauauaauugaccccuggauuagagaaaauuuuguucaggcaccacagggugaguuuacuguuucaccaaggaacucaccuggugagaugcuucuaaaucuugaauuaggcccugagcucaacccuuaucugagucacuugucccgcauguauaauggcuaugcuggugguaugcagguucaggugguccuagcugggaaugcguucacagcugguaaaaucaucuuugccgccgucccaccacauuucccuguugagaacauuagugcagcccaaaucacaaugugcccccauguaauuguugauguaagacagcuugagccagugcuuuugccccucccugacauaaggaauagauucuuucauuauaaucaggaaaauaccccccggaugagacuuguggcuauguuguauacaccccuuagagcaaauucuggugaggauguguuuacggugucuugcagaguucugacccgcccugcccccgacuuugaguucacguuuuuggugccaccaacuguggagucaaagacuaagcccuuuacacucccuauucugacucuuggagagcuguccaacuccagauuccccgcuccgauagacauguuguacacugaccccaaugaggcaauuguggugcaaccacaaaauggcaggugcacucuagauggaacacuucaggggaccacccaacugguacccacccaaauuugcuccuucaggggcacgcuaauuagccagacgucgaggucugcagauucaacagauucagccccacgggugaggaaccacccucuccacguucagcugaagaaccucgaugggacaccauaugacccaacagaugaggugccagcaguuuugggugccauagauuucaaaggaacuguguuuggggucgcuagccaaagaaacaccacagggaacucuauaggagcaacccgcgcccaugaagugcacauagacaccacaaacccuagauacaccccaaagcuuggcucuguguugauguauucugaaucuacugauuuugaugauggacaacccacccgcuuuacccccauuggcaugggagccgaugauuggcaccaaugggaauugcccgaauauucuggucaccucacucuuaacaugaauuuggcccccgcaguugccccugcuuucccuggugagcgcauucucuucuucagaucaguggugccgucugcugguggcuauggaucaggucacauagauugccucaucccacaggaguggguucagcauuucuaccaggaggccgcuccaucacaguccgcgguggcucuuaucagauaugucaacccugacacuggaagaaacaucuuugaggcaaaacugcauagagaaggguucaucacuguggcaaauucuggaaacaaccccauaguugugcccccaaaugguuacuuuagguuugaggccugggucaaucaauucuacacacucacccccaugggaacuggacaggggcgcagaagaguucaauaa

SEQ ID NO: 6632 - RNA, 1617 nt, Artificial Sequence; identical to SEQ ID NO: 6198
  major_capsid_protein__Norovirus__AJW67368

SEQ ID NO: 6633 - RNA, 1617 nt, Artificial Sequence
  major_capsid_protein__Norovirus__AJW67371
auggcgucgaaugacgcuacuccaucaaaugauggugcugccggccucgugccagaaaguaacaaugaggcuauggcucuggaacccguggugggggcgucuuuagccgccccugucacuggccaaacuaauauaauagaccccuggauuagaacuaauuuuguccaagccccuaauggugaauucacaguuuccccuagaaauuccccuggagagauauuggucaauuuggaauuagguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagcccuucccaaauaacaauguucccacaugugauuaucgauguuagaaccuuagaaccuguacugcucccaaugccugauguuagaagcacccuauuccacuuuaaucaaaaggaugaaccuaagaugagacuuguugccaugcucuacaccccucuucguucuaauggcucuggugaugacguuuucacugucucauguaggauccucacuaggcccucuccugaauuugauuucacauacuugguaccaccaacaguggagucaaagaccaagccauucacacuaccugugcugacauugggagaauuguccaauucuagauucccucucucuauugaugaaauggucaccagcccuaaugaguccauaguuguucagccacagaaugguagggucacacuagauggggaguuguuaggcacaacccaacugcaagcauguaacauuuguuccauaagggggaaagugacaggacaggucccuaaugaacaacacauguggaaccuggagauuacaaaccuaaaugggacgcaauuugacccuacagaugaugucccagccccucuuggugugcccgacuuugcaggugaggucuuugguguacucagccagagaaauagaggugaaagcaauccagcaaacagggcucaugaugcuguuguggcuaccuacagugauaaauacaccccuaaauugggcuuagugcaaauugggacuuggaacaccaacgauguugaaaaccagccaacaaaauucaccccaauugguuugaaugaggucgccaauggccaucgauuugaacaguggaccuugccuagguauucuggugcccugacacuaaauaugaauuuagcuccugcuguggccccgcucuuuccuggagagcgucuccuuuucuuccgcucuuacgucccauuaaaagguggauuuggaaacccugcuauagauugucuagugccucaggaguggguccaacauuucuaucaggaaucugccccaucucugggggaugucgccuuagucagguacgucaacccagacaccgggcgcguccuuuuugaggccaaacuccacaaagguggguuccugaccgugucaagcacuagcacagggccuguuguggucccagccaaugguuauuucagauuugauucuuggguuaaucaauuuuacucucuugcccccaugggaacugggaaugggcgcagaagguuucaguaa

SEQ ID NO: 6634 - RNA, 1623 nt, Artificial Sequence
  major_capsid_protein__Norovirus__AJW67374
auggcgucgaaugacgccgcuccaucgaaugauggugcagcuagucucguaccagaggccauuaaugagacuaugccauuggaacccguugcuggcgcaucuauugcugccccaguggcgggacagacuaacauaauugaccccuggauaagaacaaauuuugugcaagccccuaauggagaguuuacaguaucaccgagaaauuccccuggagagauucuauuaaauuuagaguuaggaccagacuugaauccuuauuuggcccaucuaucaaggauguacaauggguaugcuggagguguugaggugcaagugcuucuugcugggaacgcguucacagcaggaaagauauuauuugcagcaaucccacccaacuuuccuguagauaugauuagcccagcucaaauuacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugauuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcuguuaucaagugcaguuugcucuuacaggggcaggacuguggcuaacaguggggacaauugggaccagaauuugcuccaguugaccuacccaagcggugcaagcuaugaccccacugaugaaguaccagcacccuugggcacccaagauuucagugggauauuguaugggguguuaacccaggacaauguaagugaggguacaggggaggccaaaaaugcuaagggaguauacauauccaccaccaguggaagauucaccccaaaaauugggacaauuggauugcauucaauaacugaaaaugugcaccccaaucagcaaucacgguucacccccguuggagucgcucagaaugaaaacacccccuuccagcaauggguucuaccacacuaugcaggugcucucgcucuaaacaccaauuuggcacccgcuguugccccgacuuucccuggcgagcaauuacuguucuucaggucccgugucccauguguucaaggucugcgggggcaggaugcuuucauagauugucuccuaccucaagagugggugaaccauuuuuaucaagaggcugcucccucccaagcagacguugcccucaucagguaugucaacccugauacuggucgcacgcuguuugaggccaaauugcacaggucagguuuuauuacuguaucacacacugguaacuacccucuugugguccccccgaauggucauuucagguuugauucuuggguuaaccaauucuacucacucgcccccaugggaacuggcaaugggcguagaagaguucaauaa

SEQ ID NO: 6635 - RNA, 1635 nt, Artificial Sequence
  major_capsid_protein__Norovirus__AJW67377
augaugauggcgucuaaggacgcuacaccaagcgcagauggcgccacuggcgccggccagcugguaccggagguuaauacagcugacccuauacccauugacccuguggcuggcuccucuacagcacuugccacugcaggccaaguuaauuugauugaucccuggauaaucaauaauuuugugcaagccccccagggugaauucacaauauccccaaacaauacccccggugaugugcuuuuugauuugcaguuaggaccucauuuaaacccuuuccucucccaucucucucagauguacaauggcugggugggcaacaugcgagugcguguugucuuggcugguaaugcuuucacggcugggaagguuauaauauguuguguccccccuggcuuucaaucucguacucuuuccauagcucaggcuacuuuauucccccacgucauugcugauguuaggacccuugacccuguagaagugccccuugaagaugucaggaacguguuguaucauaauaaugacacccaacccaccaugcgccuccuuugcaugcuguacaccccucuccgcaccgggggggcgucuggugggacugauucuuucgugguagcugggcguguacuuacuugcccaggcccugacuuuaacuucuuauucuuggucccuccuacagucgagcaaaagacucgcccuuucacugugccuaauaucccuuugaaguaucugucuaauuccagaaucccaaaccccauugaaggcaugucauugucaccugaucagacucaaaauguccaauuccagaauggcaggugcacaauugacggucaaccccucgggacuacaccugucucgguuagccaguuauguaaguuuagggguaggauuacaucuggacagaaggugcucaauuugacagaguuggaugguucaccuuuuauggccuuugcugccccugccccugcgggcuucccagaccuuggguccugugauuggcauauugagaugaguaaaaucccaaauucuagcaccgagaguaauccaauaguggucaauucugucaagcccaauagucaacaguuugucccucacuugucaagcaucacccuugaugacaauguuucuagugggggugauuauauugguacuauacaauggaccucuccuccuucugauucuggcggagccaauacaaacuuuuggaaaaucccuaacuaugggucuagcuuggcugaagcuucacaguuggcuccugcugucuauccaccugguuucaaugaagugauuguguauuuuauggcaucuauaccuggccccaaucaaucuggguccccuaacuuggugccaugccuacucccccaggaauauauaacacauuucauuagugagcaggcccccauucagggugaggcugccuuacuccauuauguggacccagacaccaaucguaauuugggugaguuuaaauuguauccuggugguuauuuaaccuguguuccuaauaguucuaguacuggaccucaacagcuuccucuugaugguguuuuugucuuugcuucuugggucucuagauuuuaucaauuaaagccugugggaacagccggaccggcuagagguaggcuugguguccguagauaa

SEQ ID NO: 6636 - RNA, 1617 nt, Artificial Sequence
  major_capsid_protein__Norovirus__AJX18190
auggcgucgaaugacgcuacuccaucaaaugauggugcugccggccucgugccagaaaguaacaaugaggcaauggcucuggaacccguggugggggcgucuuuagccgccccugucacuggccaaacuaauauaauagaccccuggauuagaacuaauuuuguccaagcccccaauggugaauucacaguuuccccuagaaauuccccuggagagauauuggucaauuuggaguuagguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagcccuccccaaauaacaauguucccacaugugauuaucgauguuagaaccuuagaaccuguacugcucccaaugccugaugucagaagcacccuuuuccacuuuaaucaaaaggaugaaccuaagaugagacuuguugccaugcuuuacaccccucuucguucuaauggcucuggugaugacguuuucacugucucauguaggauccucacuaggcccuccccugaauuugauuucacauacuuggugccaccaacaguggagucaaagaccaagccauucacacuaccugugcugacacugggagaauuguccaauucuagauucccucucucuauugaugaaauggucaccagcccuaaugaguccauaguuguucagccacagaaugguagggucacacuagauggggaguuguuaggcacgacccaacugcaagcauguaacauuuguuccauaagggggaaagugacaggacaggucccuaaugaacaacacauguggaaccuggagauuacaaaccuaaaugggacgcaauuugacccuacagaugaugucccagccccucuuggugugcccgacuuugcaggugaggucuuugguguacucagccagagaaauagaggugaaagcaauccagcaaacagggcucaugaugcugucguggcuaccuacagugauaaauacaccccuaaauugggcuuagugcaaauugggacuuggaacaccaacgauguugaaaaccagccaacaaaauucaccccaauugguuugaaugaggucgccaauggccaucgauuugaacaguggacuuugccuagguauucuggcgcccugacauuaaauaugaauuuagcuccugcuguggccccgcucuuuccuggagagcgucuccuuuucuuccgcucuuacgucccauuaaaagguggauuuggaaacccugcuauagauugucuagugccucaggaguggguccaacauuucuaucaggaaucugccccaucucugggggauguggccuuagucagguacgucaacccagacaccgggcgcguccuuuuugaggccaaacuccacaaagguggguuccugaccgugucaagcacuagcacagggccugucguggucccagccaauggcuauuucagauuugauucuuggguuaaucaauuuuacucucuugcccccaugggaacugggaaugggcgcagaagguuucaguaa

SEQ ID NO: 6637 - RNA, 1617 nt, Artificial Sequence
  major_capsid_protein__Norovirus__AJX18193
auggcgucgaaugacgcuacuccaucaaaugauggugcugccggccucgugccagaaaguaacaaugaggcaauggcucuggaacccguggugggggcgucuuuagccgccccugucacuggccaaacuaauauaauagaccccuggauuagaacuaauuuuguccaagccccuaauggugaauucacaguuuccccuagaaauuccccuggagagauauuggucaauuuggaguuagguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagcccuucccaaauaacaauguucccacaugugauuaucgauguuagaaccuuagaaccuguacugcucccaaugccugaugucagaagcacccuuuuccacuuuaaucaaaaggaugaaccuaagaugagacuuguugccaugcucuacaccccucuucguucuaauggcucuggugaugacguuuucacugucucauguaggauccucacuaggcccucuccugaauuugauuucacauacuuggugccaccaacaguggagucaaagaccaagccauucacacuaccugugcugacauugggagaauuguccaauucuagauucccucucucuauugaugaaauggucaccagcccuaaugaguccauaguuguucagccacagaaugguagggucacacuagauggggaguuguuaggcacaacccaacugcaagcauguaacauuuguuccauaagggggaaagugacaggacaggucccuaaugaacaacacauguggaaccuggagauuacaaaccuaaaugggacgcaauuugacccuacagaugaugucccagccccucuuggugugcccgacuuugcaggugaggucuuugguguacucagccagagaaauagaggugaaagcaauccagcaaacagggcucaugaugcuguuguggcuaccuacagugauaaauacaccccuaaauugggcuuagugcaaauugggacuuggaacaccaacgauguugaaaaccagccaacaaaauucaccccaauugguuugaaugaggucgccaauggccaucgauuugaacaguggaccuugccuagguauucuggugcccugacacuaaauaugaauuuagcuccugcuguggccccgcucuuuccuggagagcgucuccuuuucuuccgcucuuacgucccauuaaaagguggauuuggaaacccugcuauagauugucuagugccucaggaguggguccaacauuucuaucaggaaucugccccaucucugggggauguggccuuagucagguacgucaacccagacaccgggcgcguccuuuuugaggccaaacuccacaaagguggguuccugaccgugucaagcacuagcacagggccuguuguggucccagccaaugguuauuucagauuugauucuuggguuaaucaauuuuacucucuugcccccaugggaacugggaaugggcgcagaagguuucaguaa

SEQ ID NO: 6638 - RNA, 1623 nt, Artificial Sequence; identical to SEQ ID NO: 5212
  major_capsid_protein__Norovirus__AJZ77004

SEQ ID NO: 6639 - RNA, 1623 nt, Artificial Sequence
  major_capsid_protein__Norovirus__AJZ77010
augaagauggcgucgaaugacgccagcccaucugauggguccgcagccaaccucgucccagaggucaacaaugagguuauggcuuuggagcccguugucggugccgcaauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauucacugucccaaucuuaacuguugaagaaaugacuaauucaagauuccccauuccuuuggaaaaguuguucacgggucccagcggcgccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggccauaaagcuacaguuuauacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccgaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 6640 - RNA, 1623 nt, Artificial Sequence
  major_capsid_protein__Norovirus__AJZ77013
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaagcaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggagacgaugucuucacaguuucuugucggguucucacgagaccaucccccgacuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuaggcaccacucaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccauaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucauaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugagugcaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacgugcauuauaa

SEQ ID NO: 6641 - RNA, 1623 nt, Artificial Sequence; identical to SEQ ID NO: 4943
  major_capsid_protein__Norovirus__AJZ77015

SEQ ID NO: 6642 - RNA, 1623 nt, Artificial Sequence; identical to SEQ ID NO: 4941
  major_capsid_protein__Norovirus__AJZ77019

SEQ ID NO: 6643 - RNA, 1623 nt, Artificial Sequence; identical to SEQ ID NO: 6619
  major_capsid_protein__Norovirus__AJZ77022

SEQ ID NO: 6644 - RNA, 1623 nt, Artificial Sequence; identical to SEQ ID NO: 5307
  major_capsid_protein__Norovirus__AJZ77027

SEQ ID NO: 6645 - RNA, 1623 nt, Artificial Sequence; identical to SEQ ID NO: 5216
  major_capsid_protein__Norovirus__AJZ77030

SEQ ID NO: 6646 - RNA, 1623 nt, Artificial Sequence; identical to SEQ ID NO: 5213
  major_capsid_protein__Norovirus__AJZ77033

SEQ ID NO: 6647 - RNA, 1623 nt, Artificial Sequence; identical to SEQ ID NO: 5213
  major_capsid_protein__Norovirus__AJZ77036

SEQ ID NO: 6648 - RNA, 1623 nt, Artificial Sequence
  major_capsid_protein__Norovirus__AKE31849
augaagauggcgucgagugacgccaacccaucugauggguccacagccaaccucgucccagaggucaacaaugagguuauggcuuuggagcccguaguuggugccgccaucgcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccacuuggccagaauguacaaugguuaugcaggugguuuugaagugcaggugauccuugcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacucaacugucuccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaagccacaaggacaaauggcucgacccgcggccacaaagcuacaguguacacugggagcgccgacuuuucuccaaaacuggguagaguucaauuugccacugacacagacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguagccccuacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaacccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6649 - RNA, 1623 nt, Artificial Sequence
  major_capsid_protein__Norovirus__AKE31852
augaagauggcgucgagugacgccaacccaucugauggguccacagccaaccucgucccagaggucaacaaugagguuauggcuuuggagcccguaguuggugccgccauugcggcaccuguggcgggccaacaaaauguaauugaccccuggauuagaaauaauuucguacaagccccugguggagaguuuacaguauccccuagaaacgcuccaggugaaauauuauggagcgcgcccuuaggcccugaucugaaucccuaccuuucucauuuggccagaauguacaaugguuacguaggugguuuugaagugcagguaauccucgcggggaacgcguucaccgccgggaaaaucauauuugcagcagucccaccaaauuucccaacugaagguuugagccccagccaggucacuauguucccccauauaauaguggauguuaggcaauuggaaccuguguugauccccuuacccgauguuaggaauaauuuccaccauuauaaucaaucaaaugaccccaccaucaaguugauagcaauguuguacacaccacuuagggcuaauaaugcuggggacgacgucuucacaguuucuugucgaguucuuacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacuguccccugucaacaucugcaccuucagaggggaugucacccauauuccaggcagucguaacuacacaaugaauuuggccucccaaaacuggaacaguuacgauccaacagaagaaaucccagccccucugggaacuccagauuucguggggaagauucaaggcgugcucacccaaaccacaaggacaaauggcucgacccgcggccacaaagcuacaguguacacugggagcgccgacuuuucuccaaaacuggguagaauucaauuugccacugacacagacaaugauuuugaaaccaaccaaaacacaaaguucaccccagucgguguuauccaggaugguaguaccaccccccgaaaugaaccccaacaaugggugcucccaaguuacucaggcagaaacacucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccugggucaaccaguuuuacacacuugcccccaugggaaaugggacggggcguagacgugcauuauaa

SEQ ID NO: 6650 - RNA, 1623 nt, Artificial Sequence
  major_capsid_protein__Norovirus__AKE31855
augaagauggcgucgagugacgccaacccaucugauggguccacagccaaccucgucccagaggucaacaaugagguuauggcuuuggagcccguaguuggcgccgccauugcggcaccuguagcgggccaacaaaauguaauugaccccuggauuagaagcaauuuuguacaagccccugguggagaguuuacaguauccccuagaaacgcuccaggugaaauacuauggagcgcacccuuaggcccugauuugaaucccuaccuuucccauuuggccagaauguacaaugguuaugcaggugguuuuguagugcagguaauccucgcggggaacgcguucaccgccgggaaaaucauauuugcagcagucccaccaaauuucccaacugaagguuugagccccagucaggucacuauguucccccacauaauaguagaugcuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucuccugucaacaucugcaccuucagaggggaugucacccacauuucaggcagucguaacuacacaaugaauuuggcuucccaaaauuggaacaguuacgauccaacagaagaaaucccagccccucuaggaacuccagauuucguggggaagauucaaggugugcucacccaaaccacaaagacagauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacccauaauguacaccuggcccccgcuguagcccccacuuucccgggcgagcagcuccucuucuucagaucuacuaugcccggaugcagcggguaccccaacauggaucuggacugucugcucccccaggagugggugcaguauuucuaccaggaggcagccccagcacaaucugacguggcucuguuaagauuugugaauccagauacagguaggguuuuguuugaguguaagcuucauaaaucaggcuaugucacaguggcucacaccggccaacaugauuugguuaucccccccaaugguuauuuuagauuugacuccugggucaaccaguucuacacacuugcccccaugggaaaugggacggggcguagacgugcacuauaa

SEQ ID NO: 6651 - RNA, 1623 nt, Artificial Sequence
  major_capsid_protein__Norovirus__AKE31858
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguaucccccagaaacgcuccaggugaaauacuauggagcgcacccuuaggcccugauuugaaucccuaccucucccauuuggccagaauguacaaugguuaugcaggugguuuugaagugcagguaauccucgcggggaacgcguucaccgccgggaaaaucauauuugcagcagucccaccaaauuucccaacugaagguuugagccccagucaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucucccgucaacaucugcaccuucagaggggaugucacccacauuucaggcagucguaacuacacaaugaauuuggcuucccaaaauuggaacaguuacgauccaacagaagaaaucccagccccucuaggaacuccagauuucguggggaagacucaaggugugcucacccaaaccacaaagacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgagaugaaccccagcaaugggugcucccaaguuacucaggcagaaacacccauaauguacaccuggcccccgcuguagcccccacuuucccgggcgagcagcuccucuucuucagaucuacuaugcccggaugcagcggguaccccaacauggaucuggaccgucugcucccccaggagugggugcaguauuucuaucaggagccagccccagcacaaucugacguggcucuguuaagauuugugaauccagauacagguaggguuuuguuugaguguaagcuucauaaaucaggcuauguuacaguggcucacacuggccaacaugauuugguuaucccccccaaugguuauuuuagauuugauuccugggucaaucaguucuauacacuugcccccaugggaaaugggacggggcguagacgugcacuauaa

SEQ ID NO: 6652 - RNA, 1623 nt, Artificial Sequence
  major_capsid_protein__Norovirus__AKE31861
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguucacaguauccccuagaaacgcuccaggugaaauacuauggagcgcacccuuaggcccugauuugaauccuuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagucaggucacuauguucccccacauaauaguagauguuaggcaauuggaaccuguguugauucccuuacccgauguuaggaauaauuucuaccauuauaaucaaucaaaugaccccaccaucaaauugauagcaagguuguacacaccacuuagggcuaauaaugccggggacgaugucuucacaguuucuugucgaguccucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucuccugucaacaucugcaccuucagaggggaugucacccacauuucaggcagucguaacuacacaaugaauuuggcuucccaaaauuggaacaguuacgauccaacagaagaaaucccagccccucuaggaacuccagauuucguggggaagauucaaggugugcucacccaaaccacaaagacgaauggcucgacccgcggccacaaagcuacaguguacacugggagcgccgauuuuuccccaaaacuggguagaguucaauuugccacugacacagauaaugacuuugaaacuaaccaaaacacaaaguucaccccagucgguguuauccaggaugguaguacuaccccccgaaaugaaccccaacaaugggugcucccaaguuacucaggcagaaacacccauaauguacaccuggcccccgcuguagcccccacuuucccgggcgagcagcuccucuucuucagaucuacuaugcccggaugcagcggguaccccaacauggaucuggacugccugcucccccaggagugggugcaguauuucuaucaggaggcagccccagcacaaucugacguggcucuguuaagguuugugaauccagauacagguaggguuuuguuugaguguaagcuucauaaaucaggcuauguuacaguggcucauacuggccaacaugauuuggucaucccccccaaugguuauuuuagauuugauuccuggguuaaccaguuccacacacuugcccccaugggaaaugggacggggcguagacgugcacuauaa

SEQ ID NO: 6653 - RNA, 1623 nt, Artificial Sequence
  major_capsid_protein__Norovirus__AKE31864
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaccugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguuuccccauauaauaguagauguuaggcaauuggaaccuguauugauccccuuacccgauguuaggaauaauuucuaucauuauaaucaaucaaaugaccccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaauuguccccugucaacauccgcaccuucagaggggaugucacccauauuccaggcagucguaacuacacaaugaauucggccucccaaaauuggaacaguuacgauccaacagaagaaaucccagccccucuaggaacuccagauuucguggggaagauucaaggugugcucacccaaaccacaagggcaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggauggcagcaccaccccccgaaaugaaccccaacaaugggugcucccaaguuacucaggcagaaacauucauaaugugcaccuggcccccgcuguagcccccacuuucccgggcgaacagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugccccuaugggaaaugggacggggcguagacgugcauuauaa

SEQ ID NO: 6654 - RNA, 1623 nt, Artificial Sequence
  major_capsid_protein__Norovirus__AKE31867
augaagauggcgucgagugacgccaacccaucugauggguccacagccaaccucgucccagaggucaacaaugagguuauggcuuuggagcccgugguuggcgccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaccugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguuuccccauauaauaguagauguuaggcaauuggaaccugugucgauccccuuacccgauguuaggaauaauuucuaucauuauaaucaaucaaaugaccccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaauuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaagggcaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggauggcagcaccaccccccgaaaugaaccccaacaauggguacucccaaguuacucaggcagaaacauucauaaugugcaccuggcucccgcuguagcccccacuuucccgggcgaacagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugccccuaugggaaaugggacggggcguagacgugcauuauaa

SEQ ID NO: 6655 - RNA, 1623 nt, Artificial Sequence
  major_capsid_protein__Norovirus__AKE31870
augaagauggcgucgagugacgccaacccaucugauggguccacagccaaccucgucccagaggucaacaaugagguuauggcuuuggagcccguaguuggugccucuauugcggcaccuguggcgggccaacaaaauguaauugaccccuggauuagaaauaauuuuguacaagccccugguggagaguuuacaguauccccuagaaacgcuccaggugaaauauuauggagcgcgcccuuaggcccugaucugaaucccuaccuuccucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguggauguuaggcaauuggagccuguguugauccccuuacccgauguuaggaauaauuucuaccauuauuaucaaucaaaugaccccaccaucaaauugauagcaauguuguacacaccacuuagggcuaauaaugcuggggacgacgucuucacaguuucuugucgaguucuuacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuucaggcagucguaacuacacaaugaauuuggccucccaaaacuggaacaguuacgauccaacggaagagaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaucccaacaaugggugcucccaaguuacucaggaagaaacacucauaaugugcaccuggcccccgcuguagccccuacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccugggucaaccaguuuuacacacuugcccccaugggaaaugggacggggcguagacgugcauuauaa

SEQ ID NO: 6656 - RNA, 1623 nt, Artificial Sequence
  major_capsid_protein__Norovirus__AKE31873
augaagauggcgucgagugacgccaacccaucugauggguccacagccaaccucgucccagaggucaacaaugagguuauggcuuuggagcccguaguuggugccgcuauugcggcaccuguggcgggccaacaaaauguaauugaccccuggauuagaaauaauuuuguacaagccccugguggagaguuuacaguauccccuagaaacgcuccaggugaaauauuauggagcgcgcccuuaggcccugaucugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguggauguuaggcaauuggagccuguguugauccccuuacccgauguuaggaauaauuucuaccauuauaaucaaucaaaugaccccaccaucaaauugauagcaauguuguacacaccacuuagggcuaauaaugcuggggacgacgucuucacaguuucuugucgaguucuuacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuucaggcagucguaacuacacaaugaauuuggccucccaaaacuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaauggaugcucccaaguuacucaggaagaaacacucauaaugugcaccuggcccccgcuguagccccuacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguugagauuugugaauccagacacagguaggguuuuguuugagugcaagcuucauaaaucaggcuauguuacaguggcucacacuggccaacaugauuugguuaucccccccaaugguuauuuuagauuugauuccugggucaaccaguuuuacacacuugcccccaugggaaaugggacggggcguagacgugcauuauaa

SEQ ID NO: 6657 - RNA, 1623 nt, Artificial Sequence
  major_capsid_protein__Norovirus__AKE31876
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuguggagcgcgcccuuaggcccugauuugaaucccuaccuuucccauuuggccagaauguacaaugguuaugcagguggcuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaauaaugcccgggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccucuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagagaucccagccccccuaggaacuccagauuucguggggaagauucaaggugugcucacccaaaccacaaggacagaugguucgacccgcggccacaaagcuacaguguacacugggagcgccgacuuuucuccaaaacuggguaggguucaauuugccacugacacagacaaugauuuugaaacuaaccaaaacacaaaguucaccccagucgguguuauccaggauggugguaccacccaccgaaaugaaccccaacaaugggugcucccaaauuacucaggcagaaacacucauaaugugcaccuggcccccgcuguagcccccacuuucccgggcgagcagcuccucuucuucagaucuaccaugcccggaugcagcggguaccccaacauggauuuggacugccugcuuccccaggaaugggugcaguauuucuaccaggaggcagccccagcacaaucugauguggcacuguuaagauucgugaauccagauacagguaggguuuuguuugaguguaagcuucauaaaucagguuauguuacaguggcucacacuggccaacaugauuuaguuaucccccccaaugguuauuuuagauuugauuccugggucaaccaguucuacacacuugcccccaugggaaaugggacggggcguagacgugcauuauaa

SEQ ID NO: 6658 - RNA, 1632 nt, Artificial Sequence
  major_capsid_protein__Norovirus__AKF02368
augaagauggcgucgaaugacgccgcuccaucuaaugauggugcagccggucucguaccagagaucaacaacgagacaauggcuuuggaaccaguggcaggaggagcaauugcagccccacuaacuggacaaacaaauuucauugaucccuggauuagagguaauuaugugcaagcaccaaauggugaauuuacagugucccccagaaauucgcccggugaaauuuugcuuaauuuagaauuaggcccugaacucaacccauucuugucccaucuaucuagaauguacaauggguaugcuggcgguauugauguccaagucaucauggcaggcaaugccuucaccgcugguaagauuaucuuugcagcaauaccuccccacuuccccguggaaaaucuuagucccccucagaucacuauguucccucauauuauaguggaugucaggacccuugaacccauaaacaucccuguaccagauguuaggaacaacuucuuccauuauaaucaaaacaaugagucucgcaugagacugguggccauguuguacaccccucuuaggucuaaugggucugcugaagauguuuucacagugucauguagggucuuaacaaaaccaucugcagacuuugaauucaauuaucuaguccccccaacuguagagucaaggacuaaacccuucacaauaccaauacucacaauuggggaaaugacaaauucaagauucccagugccuauugacaugcuucauaccaguccaacagaaaacauuguuguucaaccacaaaauggcaggugcaccauagauggugaguugcuuggcaccacucaacugaucacuuccaauaucuguucauucagaggguccaucucagggcaugagggcaaugaugaccaacaccuguggcacuucaacaucacaaaccccaauggcacuccauuugaccccacugaagaugugccugccccccucggaaccccagauuucaggggucaauuguacggugucaucucccagcgagauagagagggaacacccucggaaaacaaucagaaggcaaacaggucccacgagggggugauuucaacaaucucaccaaaauuuguccccaaguuagguucagucaugauuggcacauggacuacugacgauaucaagaaccagccauccaaguucaccccaauuggccucaaugaugaugauaauuuuaaacaaugggaacugccaaauuauucuggggcgcucacccucaacaugggguuggcaccuaguguuuuccccaccuacccuggugaacaaguccuuuucuuccgcuccuaucugccaaugaagggaggguacgguaguccauuuauugacugccuaguaccucaagaaugggucgcucacuucuaccaggagucagcacccgcacaaacagauguggcccuaauuagguauguaaaccccgaaacaggacguguccuuuucgaggccaaauugcacagacagggguuuauuaccguugccaagagcggcgacagccccaucaaugugccugccaaugguuauuuuagguuugauucuuggguuaaucaguuuuacucucuugcccccaugggaacugggaacgggcgcagaaggauucaguaa

SEQ ID NO: 6659 - RNA, 1644 nt, Artificial Sequence
  major_capsid_protein__Norovirus__AKF42429
augaagauggcgucgaaugacgcugcuccaucgaaugauggugcugccaaccucguaccagaggccaccaaugagguuauggcacuugagccgguggugggagccucaauugcugcuccugucgucggccaacaaaauauaauugaccccuggauuagagaaaauuuuguucaggcaccacagggugaguuuacuguuucaccaaggaacucaccuggugagaugcuucuaaaucuugaauuaggcccugagcucaacccuuaucugagucacuugucccgcauguauaacggcuaugcuggugguaugcagguucaggugguccuagcugggaaugcguucacagcugguaaaaucaucuuugccgccgucccaccacauuucccuguugagaauauuagugcagcccaaaucacaaugugcccccaugugauuguugauguaagacagcuugagccagugcuuuugccccuccccgacauaaggaauagauucuuucauuauaaucaggaaaauaccccccggaugagacuuguggcuauguuguacacaccccuuagagcaaauucuggugaggauguguuuacggugucuugcagaguucugacccgcccugcucccgacuuugaguucacguuuuuggugccaccaacuguggagucaaagacuaagcccuuuacacucccuauucugacucuuggagagcuguccaacuccagauuccccgcuccgauagacauguuguacacugaccccaaugaggcaauuguggugcaaccacaaaauggcaggugcacucuagauggaacacuucaagggaccacccaacugguacccacccaaauuugcuccuucaggggcacgcuaauuagccagacgucgaggucugcagauucaacagauucagccccacgggugaggaaccacccucuccacguucagcugaagaaccucgaugggacaccauaugacccaacagaugaggugccagcaguuuugggugccauagauuucaaaggaacuguguuuggggucgcuagccaaagaaacaccacagggaacucuauaggagcaacccgcgcccaugaagugcacauagacacuacaaacccuagauacaccccaaagcuuggcucuguguugauguauucugaaucuacugauuuugaugauggacaacccacccgcuuuacccccauuggcaugggagccgaugauuggcaccaaugggaauugcccgaauauucuggucaccucacucuuagcaugaguuuggcccccgcaguugccccugcuuucccuggugagcgcauucucuucuucagaucaguggugccgucugcugguggcuauggaucaggucacauagauugccucaucccacaggaguggguucagcauuucuaccaggaggccgcuccaucacaguccgcgguggcucuuaucagauaugucaacccugacacuggaagaaacaucuuugaggcaaaacugcauagagaaggguucaucacuguggcaaauucuggaaacaaccccauaguugugcccccaaaugguuacuucagguuugaggccugggucaaucaauucuacacacucacccccaugggaacuggacaggggcgcagaagaguucaauaa

SEQ ID NO: 6660 - RNA, 1644 nt, Artificial Sequence
  major_capsid_protein__Norovirus__AKF42434
augaagauggcgucgaaugacgcugcuccaucgaaugauggugcugccaaccucguaccagaggccaccaaugagguuauggcacuugagccgguggugggagccucaauugcugcuccugucgucggccaacaaaauauaauugaccccuggauuagagaaaauuuuguucaggcaccacagggugaguuuacuguuucaccaaggaacucaccuggugagaugcuucuaaaucuugaauuaggcccugagcucaacccuuaucugagucacuugucccgcauguauaacggcuaugcuggugguaugcagguucaggugguccuagcugggaaugcguucacagcugguaaaaucaucuuugccgccgucccaccacauuucccuguugagaacauuagugcagcccaaaucacaaugugcccccauguaauuguugauguaagacagcuugagccagugcuuuugccccucccugacauaaggaauagauucuuucauuauaaucaggaaaauaccccccggaugagacuuguggcuauguuguauacaccccuuagagcaaauucuggugaggauguguuuacggugucuugcagaguucugacccgcccugcccccgauuuugaguucacguuuuuggugccaccaacuguggaaucaaagacuaagcccuuuacacucccuauucugacucuuggagagcuguccaacuccagauuccccgcuccgauagauauguuguacacugaccccaaugaggcaauuguggugcaaccacaaaauggcaggugcacucuagauggaacacuucaagggaccacccaacugguacccacccaaauuugcuccuucaggggcacgcuaauuagccagacgucgaggucugcagauucaacagauucagccccacgggugaggaaccacccucuccacguucagcugaagaaccucgaugggacaccauaugacccaacagaugaggugccagcaguuuugggugccauagauuucaaaggaacuguguuuggggucgcuagccaaagaaacaccacagggaacucuauaggagcaacccgcgcccaugaagugcacauagacaccacaaacccuagauacaccccaaagcuuggcucuguguugauguauucugaaucuagugauuuugaugauggacaacccacccgcuuuacccccauuggcaugggagccgaugauuggcaccaaugggaauugcccgaauauucuggucaccuuacucuuaacaugaauuuggcccccgcaguugccccugcuuucccuggugagcgcauucucuucuucagaucaguggugccgucugcugguggcuauggaucaggucacauagauugccucaucccacaggaguggguucagcauuucuaccaggaggccgcuccaucacaguccgcgguggcucuuaucagauaugucaacccugacacuggaagaaacaucuuugaggcaaaacugcauagagaaggguucaucacuguggcaaauucuggaaacaaccccauaguugugcccccaaaugguuacuuuagguuugaggccugggucaaucaauucuacacacucacccccaugggaacuggacaggggcgcagaagaguccaauaa

SEQ ID NO: 6661 - RNA, 1650 nt, Artificial Sequence
  major_capsid_protein__Norovirus__AKF42437
augaagauggcgucgacugacgcugcuccaucgaaugauggugcugccaaccucguaccagaggccaacaaugagguuauggcacuugaaccgguggugggagccucaaucgcggcuccugucgucggccaacaaaacauaauugaccccuggauuagagaaaauuuuguccaagcaccacagggcgaguucaccgucucaccgagaaacucgccuggugagaugcuauuaaaucuugaauuaggcccagaacuuaacccuuaccuaagccauuugucccgcauguauaacggguaugcugguggcaugcagguucaggugguccuggcugggaaugcguucacagcugggaaaaucaucuuugccgccgugccaccacauuuucccguaaaaaacaucagugcagcccaaauaacuaugugcccccauguaauuguugaugugagacaacuugaaccaguacuuuugccccucccugacauaaggaacagguucuuucauuacaaucaggaggauaccccccggaugaggcuuguggcaaugcuuuauacuccccugagggccaauucuggugaagauguguuuacugucucuuguaggguuuuaacccguccugccccugauuuugaauucacuuucuuggugccaccaaccguugaaucaaagacuaaaccuuuuacacuacccauauuaacucuuggugagcuauccaacucuagauucccagccccgauagacauguuguacacugacccaaaugaggggguugugguccaaccacaaaaugguaggugcacucuugauggcacucugcaaggcaccacacaacugguccccacccaaauuugugcuuucaggggcaaacuaauuggccagacaucaaggucuccagacucagacucaacugacucagccccucggagaagggaucacccacuccaugugcaauuagagaaucuugauggcacgcaguacgacccaacugaugaagugccagcaacccuuggugccguugacuucaaggggaccauuuuuggaguggccagucagagagacacgucagggagucaagugggggcaacccgagcucaugaggugcacauuaacacgaccgaucccagguauacaccaaaacugggauccauccucauguacucagagucgcuagacuuugagacuggacagccgguccgcuucacacccauaggaaugggugagaacgauuggcaccagugggagcugccugacuacucuggacgccugacccugaacaugaaccuugccccagcuguugcuccugcuuuucccggugagaggauucuuuucuucaggucaauagucccaucugcugguggcuaugggucuggacagauagacugccucauaccacaggaguggguucagcauuucuaccaggaagcugcaccgucccaaucugccguggcacucaucagguaugucaauccugacacaggcagaaacaucuuugaggcuaaacugcacagggaagguuucaucaccguggcaaauucugguaacaaccccauuguuguccccccuaauggguauuuuagguuugaagcuugggugaaccaauuuuacacuuugacccccaugggaacuggucaggggcgcaggaggaaucaauaa

SEQ ID NO: 6662 - RNA, 1623 nt, Artificial Sequence; identical to SEQ ID NO: 6032
  major_capsid_protein__Norovirus__ALA27427

SEQ ID NO: 6663 - RNA, 1623 nt, Artificial Sequence
  major_capsid_protein__Norovirus__ALD09618
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccucauuuaauaguagauguuaggacucuugaaccaauuaugaucccacucccugaugcuaggaauacauucuuccauuauaguaaccagccuaacagccgcaugagauuaguggcuaugcucuacaccccacucagaucuaauggcucaggugaugaugucuuuacugucucuugcaggguuuugacuaggccuacuccugauuuugaguucacuuauuuagugccaccuucuguugaaucuaaaacuaagccuuuuucuuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaauuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaacccugauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6664 - RNA, 1623 nt, Artificial Sequence
  major_capsid_protein__Norovirus__ALM96644
augaagauggcgucgagugacgccaacccaucugauggguccacagccaaccucaucccagaggucaacaaugagguuauggcuuuagagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgauaucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaagcuguucacgggccccaguagugcccuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucgugggaaaaauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6665 - RNA, 1623 nt, Artificial Sequence
  major_capsid_protein__Norovirus__ALM96645
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaguuggaaccuguguugauccccuuacccgauguuaggaauaauuucuaucauuauaaucaaucaaaugacuccaccaucaaauugauagcaauguuguacacaccacuuagggcuaauaaugccgggggcgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaauugucuccugucaacaucugcaccuucagaggggaugucacccauauuccaggcagucguaacuacacaaugaauuuggccucccaaaacuggaacaguuacgauccgacagaagaaaucccagccccucuaggaacuccagauuuuguggggaaaguucaaggugugcucacccaaaccacaaggacaaauggcucgacccgcggccacaaagcuacaguguacacugggagcgccgacuuuucuccaaaacuggguaggguucaauuugccacugacacagacaaugauuuugaaacuaaccaaaacacaaaguucaccccagucggcguuauccaggaugguagcaccaccccccgaaaugaaccccaacaaugggugcucccaaguuacucaggcagaaacauucacaaugugcaccuggcccccgcuguagccccuacuuucccgggcgagcagcuccucuucuucagaucuacuaugcccggaugcagcggguaucccaacauggacuuggacugucugcucccccaggagugggugcaguacuucuaccaggaggcagccccagcacaaucugauguggcucuguuaagauuugugaauccagacacaguuaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6666 - RNA, 1623 nt, Artificial Sequence
  major_capsid_protein__Norovirus__ALM96646
augaagauggcgucaaaugacgccaacccaucugauggguccgcagccaaccucgucccaaaggucaacaaugagguuauggcuuuggagcccguugucggugccgcuauugcggcgccuguagcgggccaacaaaauguaauugaccccuggauuaaaaacaauuuuguacaagccccugguggaaaguucacaguauccccuaaaaaugcuccaggugaaauacuauggagcgcgcccuugggcccugaucugaaucccuaccuaucucauuuggccagaauguacaagggacaugcgggcgguuuugaagugcaggugauucucgcggggaacgcguucaccgccgggaaaauuauauuugcagcagucccaccaaauuuuccaacugaaggcuugagucccagccaggucaccauguucccccacauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccaucccuuuggaaaaguuguucacgggucccagcagugccuuuguuguucaaccacaaaauggcagaugcacgacugauggcgugcucuuaggcacuacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugacacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaagagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaaugguuauuuuagguuugauuccuggguuaaucaauucuacacgcuugcccccaugggaaauggaacggggcguagacgugcuuuauaa

SEQ ID NO: 6667 - RNA, 1623 nt, Artificial Sequence
  major_capsid_protein__Norovirus__ALM96647
augaagauggcgucaaaugacgccaacccaucugauggguccgcagccaaccucgucccaaaggucaacaaugagguuauggcuuuggagcccguugucggugccgcuauugcggcgccuguagcgggccaacaaaauguaauugaccccuggauuagaaacaauuuuguacaagccccugguggaaaguucacaguauccccuagaaacgcuccaggugaaauacuauggagcgcgcccuuaggcccugaucugaaucccuaccuaucucauuuggccagaauguacaaugguuaugcaggugguuuugaagugcaggugauucucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguccaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6668 - RNA, 1623 nt, Artificial Sequence
  major_capsid_protein__Norovirus__ALM98891
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagucgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuuuagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6669 - RNA, 1623 nt, Artificial Sequence
  major_capsid_protein__Norovirus__ALM98892
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguagaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucaagguucccaguccccaucgauucgcuuuucaccgcccagaauaacguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6670 - RNA, 1623 nt, Artificial Sequence
  major_capsid_protein__Norovirus__ALM98893
augaagauggcgucgaaugacgccgcuccaucuaaugauggugcugcuggucucguaccagagggcaacaacgagacccuuccccuagaaccaguugcgggugcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaacacauucuuccauuauaguaaccagccuaacagccgcaugagauuaguggcuaugcucuauaccccacucagaucuaauggcucaggugaugaugucuuuacugucucuugcaggguuuugacuaggcccacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacgcacacuguuugaagcaaaauugcacaggucugguuacauuacuguggcucacucuggagacuauccucuuguuguuccggcuaauggacacuuuagauuugacucuuggguaaaucaguuuuacucacucgccccaaugggaacugggaaugggcgaaggagggcucaguaa

SEQ ID NO: 6671 - RNA, 1623 nt, Artificial Sequence; identical to SEQ ID NO: 6668
  major_capsid_protein__Norovirus__ALM98894

SEQ ID NO: 6672 - RNA, 1623 nt, Artificial Sequence
  major_capsid_protein__Norovirus__ALM98895
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcucagaucacaaugcucccacauuuaauaguagauguuaggacucuugaaccaauuaugaucccacucccugauguuaggaauacauucuuccauuauaguaaccagccuaauagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugacaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacauuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6673 - RNA, 1623 nt, Artificial Sequence
  major_capsid_protein__Norovirus__ALM98896
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggggacuauccucuuguuguuccggcuaauggacacuuuagauuugauucuuggguaaaucaguuuuacucacucgccccaaugggaacugggaaugggcgaaggagggcucaguaa

SEQ ID NO: 6674 - RNA, 1623 nt, Artificial Sequence; identical to SEQ ID NO: 6219
  major_capsid_protein__Norovirus__ALM98897

SEQ ID NO: 6675 - RNA, 1623 nt, Artificial Sequence
  major_capsid_protein__Norovirus__ALM98899
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccuauucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccuuaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6676 - RNA, 1623 nt, Artificial Sequence
  major_capsid_protein__Norovirus__ALM98901
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaauuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaacuacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6677 - RNA, 1623 nt, Artificial Sequence
  major_capsid_protein__Norovirus__ALM98907
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaauuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaacuacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauauuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6678 - RNA, 1623 nt, Artificial Sequence
  major_capsid_protein__Norovirus__ALM98910
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcauuuggcccccgcuguagcccccacuuuuccgggugagcaacuucuuuuuuucagauccaccaugcccggaugcagcggguaccccaacauggacuuggacugccugcucccccaggaaugggugcaguacuucuaccaagacgcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacgugcacuauaa

SEQ ID NO: 6679 - RNA, 1623 nt, Artificial Sequence
  major_capsid_protein__Norovirus__ALM98913
augaagauggcgucgagugacgccaacccaucugauggguccgcagccaaccucgucccagaggucaacaaugagguuauggcucuggaacccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucaaggcgugcucacucaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaguacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6680 - RNA, 1623 nt, Artificial Sequence
  major_capsid_protein__Norovirus__ALM98916
augaagauggcgucgagugacgccaacccaucugauggguccgcagccaaccucgucccagaggucaacaaugagguuauggcucuggagcccguuguuggugccgccauugcggcaccuguggcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6681 - RNA, 1623 nt, Artificial Sequence
  major_capsid_protein__Norovirus__ALT54478
augaagauggcgucgagugacgccaacccaucugauggguccgcagccaaccucgucccagaggucaacaaugagguuauggcucuggagcccguugucggugccgccauugcggcaccuguagcgggccaacaaaauguaauugaccccuggauuagaaauaauuuugugcaagccccugguggagaguucacaguauccccuagaaacgcuccaggugaaauacuauggagcgcgcccuugggcccugaucuaaaucccuaccuuucccauuuggcuagaauguacaaugguuaugcaggugguuuugaagugcaggugauucucgcggggaacgcguucaccgccgggaaggucauauuugcagcagucccaccaaauuuuccaacugaaggcuugagccccagccaggucacuauguucccccacauagugguagauguuaggcaacuagaaccuguguugauucccuuacccgauguuaggaauaauuucuaucauuauaaccaaucaaaugaccccaccauuaaguugauagcaauguuguauacaccacuuagggcuaacaaugcuggggaugaugucuucacagucucuugccgaguucucacgagaccaucccccgacuuugauuucauauuucuagugccacccacaguugagucaagaacuaaaccauucucugucccaguucuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccuguuaacaucugcaccuuuagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaagggcagauggcucaacacgcggccacaaagccacaguguacacugggagcgccgacuuugcuccaaaacuggguagaguucaauuugaaacugacacagaccaugauuuugaagcaaaccaaaacacaaaguucaccccaguuggugucauccaagaugguggcaccacccaccgaaaugagccccaacagugggugcucccaaguuacucaggcagaaauacuccuaaugugcaucuggcccccgcuguagcccccacuuucccgggugagcaacuucucuucuuuagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucagguuauguuacaguggcucacacuggccaacaugauuugguuauccccccuaaugguuauuuuagguuugauuccugggucaaccaguuuuacacgcuugcccccaugggaaauggaacggggcguagacgugcacuauaa

SEQ ID NO: 6682 - RNA, 1617 nt, Artificial Sequence
  major_capsid_protein__Norovirus__ALT54488
augaugauggcgucuaaggacgcccccucaaacauggauggcaccaguggugccggucagcugguuccagagguuaaugcagcugaaccucuaccccuugaaccgguggugggcgccgcaaccgcggcggccaccgcuggacagguuaauaugauagaccccuggauuaugaauaauuuuguccaagccccugaaggcgaauuuacuauuucacccaauaacaccccuggagacauuuuauuugauuugcgucugggaccacaccuuaaccccuuucuccugcauuugucccagauguauaaugguuggguugggaauaugagaguuagggucaugcuugcagggaacgcguucucugcugguaagaucauaauuuguugugucccaccuggcuuugaaucccagaacauaucaauuggacaagccacaauguucccccaugucauugcugaugugagaguccuggagcccauagaggucccccuugaugaugugcgcaauguccuguuccacacaaaugagaaucgcccaaccaugcgauugcucuguauguuauacacaccucuccgugcuggaggagcuucaucaggcacagauccuuuugucauugcuggccguguguuaacuuguccugcuccugauuucaauuuucuguuucuugugccccccaguguagaacaaaagaccaggcaauugacuauacccaauauaccccugaacaauuuggcuaacuccagagugccugcaaugauaaacaagaugacagucucugcugaucagaaucaggugguccaguuucaaaauggccguugcacacuugaaggacaacucuuagguacaaccccuguuucagccaaccaaguugcccgcauacguggcaaagucuucuccaccaacuccgggacggggcuuaauuuaacugaaguagaugggacccccuaccaugcauuugagagcccggccccccucgguuuuccugacauaggcaauugugauuggcacguguaugccuuuaagguaaaucaaaacacaggggaccccauguacagauuggauauaacacaaggaaacucauuugcaccgcaucuuggcuccauugaguuuaguucugaaaaccacccaucgggggaccaacuaggcacacuuacuuggaucuccccucucaacaaugcuucuaggguugaucccuggaaaaucccaacauaugguucaacauugacugaguccaccaacuuggcaccacccaucuuuccaccagguuuuggugagucuauaguuuauuuuaugucagauuuuccuauugugucagguaauacugcccaaaucccuugcacccugccccaagaauuuguuucauccuuuguggagcaacaggcaccgauccgaggugaagcugcucuauugcauuauguggacccagauacccaucgcaaucugggagaauucaaauuguacccugauggguucaucacuugugugccuaacacggguggcggcccccaaaaucucccaucgaauggugucuuugucuucucuucuuggguuucuagauauuaucaauuaaagccugugggaacaaccgguccgguuaggaggcuuggugugagaaggguauaa

SEQ ID NO: 6683 - RNA, 1620 nt, Artificial Sequence
  major_capsid_protein__Norovirus__ALT54491
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaauuauauuugcugcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaagauucuaccauuaaauugauagcaaugcuguacacaccacucagggccaauaaugccggggaugacgucuucacagucucuugucgaguccucacgaggccauccccugauuuugacuucauauuucuggugccaccuacaguugagucaagaacuaagccauuuacugucccaaucuuaacuguugaagaaaugaccaauucaagauuccccauuccuuuggagaaauuguucacgggucccagcaaugccuuuguuguucaaccacaaaauggcagaugcacaacugauggcguacucuuaggcaccacccaacugucuccugucaacaucugcaccuucagaggggaugucacccaaauugcgaguacccaaacuuacacaaugaauuuggccucucuaaauuggaacaauuaugacccaacagaagagauuccagccccucugggagcuccagacuucaugggaaagauccaaggugugcucacucaaaccacaaggcaagguggcucgacccggggccauaaagcuacaguuuccacugggaguguccacuucacuccaaagcugggcaguguucgauuugacacugauacaaacaaugaccuucaaccucaucaaagcacaagauuuaccccagucggcgucauccaggauggugacacccaccaaaaugaaccccaacaaugggcgcucccauguuauucagguagagaugucaacaauguacaccuagccccugcuguagcccccaguuuuccgggugaacaacuucucuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguagggucuuguuugagugcaaacuccauaaaucaggcuaugucacaguggcucauaccggccaacauaauuuggucaucccccccaaugguuauuuuagguuugauuccuggguuaaucaguucuacacacuugcccccaugggaaauggaacggggcguagacguguuuuauaa

SEQ ID NO: 6684 - RNA, 1620 nt, Artificial Sequence
  major_capsid_protein__Norovirus__ALT54494
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaauuauauuugcugcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaagauucuaccauuaaauugauagcaaugcuguacacaccacucagggccaauaaugccggggaugacgucuucacagucucuugucgaguccucacgaggccauccccugauuuugacuucauauuucuggugccaccuacaguugagucaagaacuaagccauuuacugucccaaucuuaacuguugaagaaaugaccaauucaagauuccccauuccuuuggagaaauuguucacgggucccagcaaugccuuuguuguucaaccacaaaauggcagaugcacaacugauggcguacucuuaggcaccacccaacugucuccugucaacaucugcaccuucagaggggaugucacccaaauugcgaguacccaaacuuacacaaugaauuuggccucucuaaauuggaacaauuaugacccaacagaagagauuccagccccucugggagcuccagacuucaugggaaagauccaaggugugcucacucaaaccacaaggcaagauggcucgacccggggccauaaagcuacaguuuccacugggaguguccacuucacuccaaagcugggcaguguucgauuugacacugauacaaacaauaaccuucaaccucaucaaagcacaagauuuaccccagucggcgucauccaggauggugacacccaccaaaaugaaccccaacaaugggugcucccauguuauucagguagagaugucaacaauguacaccuagccccugcuguagcccccaguuuuccgggugaacaacuucucuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguagggucuuguuugagugcaaacuccauaaaucaggcuaugucacaguggcucauaccggccaacauaauuuggucaucccccccaaugguuauuuuagguuugauuccuggguuaaucaguucuacacacuugcccccaugggaaauggaacggggcguagacguguuuuauaa

SEQ ID NO: 6685 - RNA, 1620 nt, Artificial Sequence
  major_capsid_protein__Norovirus__BAM65003
augaugauggcgucuaaggacgcccccucaaacauggauggcacuaguggugccggucagcugguuccagagguuaaugcagcugaaccccuaccccuugagccgguggugggugccgcaacugcggcggccacugcugggcaaguuaauuuaauagaccccuggaucaugaauaauuuuguccaagccccugagggcgaauucacuaucuccccuaauaauaccccuggagauauuuuauuugauuugcaauugggaccacaucuuaacccuuuccuucaacauuugucucaaauguauaaugguuggguggggaacaugagagucagagucaugcucgcagggaacgcguucacugcugguaagaucauaauuuguugugucccgccuggcuuugcaucccaaaacauaucaauuggacaagccacaauguuuccacauguuauagcugaugugagaguauuagaaccuauugaaaucccccuugaugauguacgcaaugucuuauuccacacuaaugaaaaccgcccaacuaugcgguuacucugcaugcuguacacaccccuccgugcuggaggugcuucaucaggcacggacccuuuuguuauugcaggucguguccuaaccugcccuuccccugacuucaauuuucuguuccucguaccuccuaguguggaacagaagaccaggcaauuaacugugcccaacauacccuugaauaauuuggccaacuccagagugccugcaaugauaaacaagaugacaguuucuacugaucaaaaucagguaguccaguuccaaaauggucguugcacacucgaagggcaacuuuugggcacaaccccugucucagcuagucaaguagcccgcauacgcgguaaaguuuucuccacugcaucugggaagggacuuaaucuaacugagcuggauggaaccccuuaucaugcauuugagagcccagccccccuuggcuuuccugacauaggagccugugauuggcaugugucaacuuuuaagguggaucaaaaucuuucgggggaccccauguccaggcuagauauaaaacaaaaugccccauuugcaccacaucuugguuccauugaauucaccucugaccaggagccaaccggggaucaauugggcacacuagcuugggucucccccuccacuaguggagcuagggucgauccuuggaaaauuccaucauaugguucaacuguaacugaguccacucaccuggcaccaccuaucuuuccaccagguuuuggugaagccauagucuauuuuaugucagauuuuccuauugugucggguaacacugcucaaguucccuguaccuuaccucaagaauuuguuucacacuuuguagaacagcaggcaccaauucgaggugaagcugcccuacugcauuauguagauccagacacccaccguaauuugggagaguuuaaauuauacccugauggguucaucaccugugugccaaauacaggcgguggcccccaaaaccuuccuauaaauggagucuuugucuuuucuucuuggguuucuagauauuaccaauuaaagccugugggaacagccgguccggccaggaggcuuggugugagaaggguauaa

SEQ ID NO: 6686 - RNA, 1647 nt, Artificial Sequence
  major_capsid_protein__Norovirus__BAM65005
augaagauggcgucgaaugacgcugcuccaucuaaugauggugccgccggccucgucccagagaucaacaaugaggcaauggcgcuagacccaguggcgggugcagcgauagcagcaccccucacuggucagcaaaauauaauugaucccuggauuaugaauaauuuuguacaagcaccugguggugaguuuacaguauccccuaggaauuccccuggugaagugcuucuuaauuuggaauugggcccagaaauaaaccccuauuuggcccaucuugcuagaauguauaaugguuaugcagguggauuugaagugcaaguaguccuggcuggaaaugcguuuacagcaggaaagauaaucuuugcagcuauacccccuaauuuuccaauugauaaccugagcgcagcacagaucacaaugugcccgcaugugauuguggaugucagacaauuggaaccggucaaucuuccgaugccugacguucgcaacaauuucuuucauuauaaucaagggucugauucgagauugcgcuuaauugcaaugcuguacacaccucuuagggcaaauaauucuggggaugauguuuuuacugugucaugcagagugcugacuaggccuagcccugauuuuucauuuaauuuccuugugccacccacuguggagucaaagacaaagcccuucacccuuccuauucugacuaucucugaaauguccaauucuagguuuccaguuccgauugauucucugcacacaagcccaacugagaauauuguuguccagugccaaaacgggcgcgucacucuugacggugaguugaugggaaccacccaacucuuaccgagucagaucugugcuuucaggggcguacucacccgaucaacaagcagggccagugaucaggccgacacagcaaccccuagguuguuuaauuauuacuggcacauacaauuggauaaucuaaauggaacaccuuaugacccugcagaagacauaccaggcccccuagggacaccagauuuucggggcaaagucuuuggcguggccagccaaagaaaccccgacagcacaacuagggcacaugaagcaaagguggauacaacaucuggccguuuuaccccaaaauuaggcucauuagaaauauccacugaaucuggugacuuugaccaaaaucaaccaacaagauucacuccaguuggcauugggguugauaacgaggcagacuuucaacaauggucuuuacccgacuauucuggucaguucacccacaacaugaacuuggcaccagcuguugcccccaacuucccuggugagcagcuccucuucuuccgcucacaguuaccaucuucugguggacgguccaacgggauucuagacugccuaguuccccaagaauggguucagcacuucuaccaagaaucggcccccgcccaaacacagguggccuugguuagguaugucaacccugacacugguagaguguuauuugaggcuaagcugcacaaauuagguuucaugacuauagcuaagaguggugauuccccaauaacugucccuccaaauggauauuuuagauuugaaucuugggugaaccccuuuuauacacuugcccccaugggaacugggaaugggcgcagaaggauucaauaa

SEQ ID NO: 6687 - RNA, 1644 nt, Artificial Sequence
  major_capsid_protein__Norovirus__BAM65007
augaagauggcgucgaaugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucaccgucucgccgaggaacucgccuggugagaugcuauuaaaucuugaauugggcccagaacucaacccuuaccuaagucaccugucccguauguauaauggguaugcugguggcaugcagguucaggugguccuagcugggaaugcguucacagcugggaaaaucaucuuugccgccguaccaccacauuuucccguagaaaacauuagugcagcucaaauaacuaugugcccccauguaauuguugaugugagacaacuugaaccagugcuucugccccuuccugacauaaggaacagguucuuucauuacaaucaggagaacaccccccggaugagacuuguggcuaugcuuuacaccccccugagggccaacucuggugaagauguguuuacugucucuuguaggguuuugacccguccugccccugacuuugaauuuacuuucuugguaccaccaacuguugaaucuaagacuaaaccuuucacacugcccauauuaacucuuggugagcuaucuaacuccagauucccagccccaauagauauguuguacacugacccaaaugagggaauugugguccaaccacaaaaugguaggugcacucuugauggcacucugcaaggcaccacacaacugguccccacccaaauuugugcuuucaggggcacacuaauuggccaaacaucaagaucuucagacucaaccgacucagccccucggagaagggaucacccgcuccaugugcaauuaaagaaccuugauggcacgcaguacgacccaacugaugaagugccagcaguccuuggugccauugacuucaaggggacugucuuugggguggccagucagagagacgugucagggcaacaagugggagcaacucgagcccaugaagugcacaucaacacaaccgauccuagguauacaccaaaacugggauccauucucaugcacucagagucggacgacuuugugacuggacagccgguccgcuucacacccauaggaaugggugacaacgacuggcaccagugggagcugccugacuacucuggacaccuaacccugaacaugaaccucgccccagcagucgcuccugcuuuuccgggcgagaggauucuuuucuucaggucaauaguuccgucugcugguggcuaugggucuggacaaauagauugccucauaccacaggaguggguucagcauuucuaccaggaagcugcaccaucccaaucugccguggcacucauuagguaugucaauccugacacaggcagaaacaucuuugaggcuaaauugcacagggaagguuucaucaccguggcaaauucugguaacaaccccauuguuguccccccuaauggguauuuuagguuugaggcuugggugaaucaauuuuacacuuugacccccaugggaacuggucaggggcguaggaggaaucaauaa

SEQ ID NO: 6688 - RNA, 1623 nt, Artificial Sequence
  major_capsid_protein__Norovirus__CCX28604
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuaggcacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6689 - RNA, 1623 nt, Artificial Sequence
  major_capsid_protein__Norovirus__CCX28607
augaagauggcgucgagugacgccaacccaucugauggguccacagccaaccucgucccagaggucaacaaugagguuauggcuuuggagcccguuguuggugccgccauugcggcaccuguggcgggccaacaaaauauaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccauauaauaguagauguuagacaacuggagcccgugcugguccccuuacccgauguuaggaauaauuucuaccauuacaaucaaucaaaugaccccacuaucaaacugauagcaauguuguauacaccacuuagggcuaauaaugcuggggacgaugucuucacaguuucuugucgaguucucacgagaccaucccccgauuuugauuucauauuuuuagugccacccacaguugaaucaagaaccaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacccaauugucuccugucaacaucugcacauucagaggggaugucacccauauugcaggcagucguaacuauacaaugaaucuggcuucccaaaauuggaacaguuaugacccaacagaagaaaucccagccccucuaggaacuccagacuucgugggaaagauucaaggugugcucacccaaaccacgaggacagauggcucgacccgcggccacaaagcuacaguguacacugggagcgccgacuuuucuccaaaacuggguagaguucaauuugccacugacacagacaaugauuucgaggcuaaccaaaacacaaaguucaccccagucggugucauccaggaugguaguacugcccaccgaaaugaaccccaacaaugggugcucccaaguuacucaggcagaaauauucauaaugugcaccuggcccccgcuguagcccccacuuuuccgggugagcaacuccucuucuucagaucuaccaugcccggaugcagcggguaccccaacauggauuuggacugucugcucccccaggaaugggugcaauauuucuaccaggaagcagccccagcacaaucugauguggcucugcuaagauuugugaauccagacacagguaggguuuuguuugaguguaagcuucauaagccaggcuauguuacaguggcucacacuggccaacaugauuugguuaucccccccaauggcuauuuuagauuugauuccugggucaaccaguucuacacacuugcccccaugggaaacgggacggggcguagacgcgcauuauaa

SEQ ID NO: 6690 - RNA, 1623 nt, Artificial Sequence
  major_capsid_protein__Norovirus__CCX28619
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguaucccccagaaacgcuccaggugaaauauuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagucaggucacuauguuuccccauauaauaguagauguuaggcaauuggaaccuguguugauucccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauucuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucauaacuacacaaugaauuuggccucccaaaauuggaacaguuacgauccaacagaagaaaucccagccccucuaggaaccccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccagaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcacacacuggccaacaugauuugguuaucccccccaaugguuauuuuagauuugauuccugggucaaccaguucuacacacuugccccuaugggaaaugggacggggcguagacgugcauuauaa

SEQ ID NO: 6691 - RNA, 1623 nt, Artificial Sequence
  major_capsid_protein__Norovirus__CCX28622
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguaucccccagaaacgcuccaggugaaauacuauggagcgcacccuuaggcccugauuugaaccccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagucaggucacuauguucccccacauaauaguagauguuaggcaauuggaaccuguguugauucccuuacccgauguuaggaauaauuucuaccauuauaaucaaucaaaugaccccacuaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucuccugucaacaucugcaccuucagaggggaugucacccacauuucaggcagucguaacuacacaaugaauuuggcugcccaaaauuggaacaguuacgauccaacagaagaaaucccagccccucuaggaacuccagauuucguggggaagauucaaggugugcucacccaaaccacaaagacaaauggcucgacccgcggccacaaagcuacaguguacacugggagcgccgacuuuucuccgaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacccauaauguacaccuggcccccgcuguagcccccacuuucccgggcgagcagcuccucuucuucaggucuacuaugcccggaugcagcggguaccccaacauggaucuggacugucugcucccccaggagugggugcaguauuucuaucaggaggcagccccagcacaaucugacguggcucuguuaagauuugugaauccagauacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcacuauaa

SEQ ID NO: 6692 - RNA, 1623 nt, Artificial Sequence; identical to SEQ ID NO: 6690
  major_capsid_protein__Norovirus__CCX28625

SEQ ID NO: 6693 - RNA, 1623 nt, Artificial Sequence; identical to SEQ ID NO: 6691
  major_capsid_protein__Norovirus__CCX28628

SEQ ID NO: 6694 - RNA, 1623 nt, Artificial Sequence
  major_capsid_protein__Norovirus__CCX28631
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuuccugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuaggcacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6695 - RNA, 1623 nt, Artificial Sequence; identical to SEQ ID NO: 6690
  major_capsid_protein__Norovirus__CCX28634

SEQ ID NO: 6696 - RNA, 1623 nt, Artificial Sequence
  major_capsid_protein__Norovirus__CCX28637
augaagauggcgucgagugacgccaacccaucugauggguccacagccaaccucgucccagaggucaacaaugagguuauggcuuuggagcccguaguuggugccgccauugcagcaccuguagcgggccaacaaaauguaauugaccccuggauuagaagcaauuuuguacaagccccugguggagaguuuacaguauccccuagaaacgcuccaggugaaauacuauggagcgcacccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagucaggucacuauguucccccacauaauaguagauguuaggcaauuggaaccuguguugauucccuuacccgauguuaggaauaauuucuaccauuauaaucaaucaaaugacuccaccaucaaauugauagcaauguuguacacaccacuuagggcuaauaaugccggggacgaugucuucacaguuucuugucgaguccucacgagaccaucccccgauuuugauuucauauuuuuggugccacccacaguugaaucaagaacuaaaccguucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucuccugucaacaucugcaccuucagaggggaugucacccacauuucaggcagucguaacuacacaaugaauuuggcuucccaaaauuggaacaguuacgauccaacagaagaaaucccagccccucuaggaacuccagauuucguggggaagauucaaggugugcucacccaaaccacaaagacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauucaggaugguaguacuaccccccgaaaugaaccccaacaaugggugcucccaaguuacucaggcagaaacacccauaauguacaccuggcccccgcuguagcccccacuuucccgggcgagcagcuccucuucuucagaucuacuaugcccggaugcagcggguaccccaacauggaucuggacugucugcucccccaggagugggugcaguauuucuaucaggaggcagccccagcacaaucugacguggcucuguuaagauuugugaacccagauacagguaggguuuuguuugaguguaagcuucauaaaucaggcuauguuacaguggcucacacuggucaacaugauuugguuaucccccccaaugguuauuuuagauuugacuccugggucaaccaguucuacacacuugcccccaugggaaaugggacggggcguagacgugcacuauaa

SEQ ID NO: 6697 - RNA, 1623 nt, Artificial Sequence; identical to SEQ ID NO: 6688
  major_capsid_protein__Norovirus__CCX28640

SEQ ID NO: 6698 - RNA, 1623 nt, Artificial Sequence; identical to SEQ ID NO: 6690
  major_capsid_protein__Norovirus__CCX28643

SEQ ID NO: 6699 - RNA, 1623 nt, Artificial Sequence
  major_capsid_protein__Norovirus__CCX28646
augaagauggcgucgagugacgccaacccaucugauggguccacagccaaucucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuugcccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaaccaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuaggcacuacccaacugucuccugucaacauuugcaccuucagaggggaugucacccauauuccaggcagucguaacuacacaaugaauuuggccucccaaaauuggaacaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6700 - RNA, 1623 nt, Artificial Sequence
  major_capsid_protein__Norovirus__CCX28649
augaagauggcgucgagugacgccaacccaucugauggguccacagccaaccucgucccagaggucaacaaugagguuauggcuuuggagcccguaguuggugccgcuaucgcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccgccaaauuucccaacugaagguuugagccccagccaagucacuauguucccccacauaauaguagauguuaggcaacuggaaccuguguugauccccuuacccgauguuaggaauaauuuuuaccauuauaaucagucaaaugaccccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauuuucugucccaguuuuaacugucgaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucaggggggaugucacucacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggauguagcggguaccccaacauggauuuggacugucugcucccccaggaaugggugcaguauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacgcuugcccccaugggaaaugggacggggcguagacgugcauuauaa

SEQ ID NO: 6701 - RNA, 1623 nt, Artificial Sequence
  major_capsid_protein__Norovirus__CCX28652
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguaucccccagaaacgcuccaggugaaauacuauggagcgcacccuuaggcccugauuugaaccccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagucaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucuccugucaacaucugcaccuucagaggggaugucacccacauuucaggcagucguaacuacacaaugaauuuggcugcccaaaauuggaacaguuacgauccaacagaagaaaucccagccccucuaggaacuccagauuucguggggaagauucaaggugugcucacccaaaccacaaagacaaauggcucgacccgcggccacaaagcuacaguguacacugggagcgccgacuuuucuccgaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacccauaauguacaccuggcccccgcuguagcccccacuuucccgggcgagcagcuccucuucuucaggucuacuaugcccggaugcagcggguaccccaacauggaucuggacugucugcucccccaggagugggugcaguauuucuaucaggaggcagccccagcacaaucugacguggcucuguuaagauuugugaauccagauacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcacuauaa

SEQ ID NO: 6702 - RNA, 1626 nt, Artificial Sequence
  major_capsid_protein_VP1__Norovirus__AEE10000
augaggaugagugauggcgcagcgccaaaagccaauggcucugaagccagcggccaggaucuuguuccuaccgccguugaacaggccguccccauucagcccguggcuggugcggcucuugccgcccccgccgccgggcaaaucaaccaaauugaccccuggaucuuccaaaauuuuguccagugcccccuuggugaguuuuccauuucaccucgaaacaccccaggugaaauacuguuugauuuggcccucgggccagggcucaaccccuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcccagaucacaugcuucccacaugucaugugugaugugcgcacccuggagcccauucaacucccucuucuugaugugcgucgaguccuuuggcacgcuacccaggaucaagaggaaucuaugcgccugguuugcaugcuguacacgccacuccgcacaaacagcccgggugaugagucuuuuguggucucuggucgccuucuuucuaagccggcggcugauuucaauuuugucuaccugacuccccccauagagagaaccaucuaccggauggucgacuugcccgugauacagccgcggcugugcacgcacgcacguuggccugccccggucuauggacucuugguggacccaucccuccccucaaacccccaguggcagaauggaagggugcgcguugauggaacccugcuuggcaccacgccagucuccggcucauggguguccugcuuugcagcggaggcugccuaugaguuccaaucaggcaccggcgagguggcgacauucacucugauugagcaggauggaucugccuacguccccggcgacagggcagcaccacucgguuaccccgauuucuccgggcaacuggagaucgagguucagaccgagaccaccaagacuggagacaagcucaagguuaccaccuuugagaugguucuuggcccagagaccaacguggaucaggcccccuaccagggcaggguguacgccagcgucaacgcugcggccucccucgacuugguggauggcaggguucgcgcggucccaagauccgucuacaguuuccaagaugucaucccugaguauaaugauggguugcugguuccccuugcccccccaauuggccccuuucuucccggcgagguucucuugagguuccggaccuacaugcgucagauugacaccacugacgccgcagcagaggcaauagacugugcacucccccaggaguuuaucuccugguucgcgucuaacgcguucaccgugcaguccgaggcccugcuccuuagguacaggaacacccugacugggcaacugcuguuugagugcaagcucuacagcgaagguuacaucgccuuguccuauucugguucaggagcccucaccuucccgaccgauggcuucuuugaggucgucagcugggucccccgucuuuaccaauuggccucugugggaagcuuggcaacaggccgaacacucaaacaauaa

SEQ ID NO: 6703 - RNA, 1626 nt, Artificial Sequence
  major_capsid_protein_VP1__Norovirus__AEE10012
augaggaugagugauggcgcagcgccaaaagccaacggcucugaagccagcggccaggaucuuguuccuaccgccguugaacaggccguccccauucagcccguggcuggugcggcucuugccgcccccgccgccgggcaaaucaaccaaauugaccccuggaucuuccaaaauuuuguccagugcccccuuggugaguuuuccauuucaccucgaaacaccccaggugaaauacuguuugauuuggcccucgggccagggcucaaccccuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcccagaucacaugcuucccacaugucaugugugaugugcgcacccuggagcccauucaacucccucuucuugaugugcgucgaguccuuuggcacgcuacccaggaucaagaggaaucuaugcgccugguuugcaugcuguacacgccacuccgcacaaacagcccgggugaugagucuuuuguggucucuggucgccuucuuucuaagccggcggcugauuucaauuuugucuaccugacuccccccauagagagaaccaucuaccggauggucgacuugcccgugauacagccgcggcugugcacgcacgcacguuggccugccccggucuauggacuccugguggacccaucccuccccucaaacccccaguggcagaauggaagggugcgcguugauggaacccugcuuggcaccacgccagucuccggcucauggguguccugcuuugcagcggaggcugccuaugaguuccaaucaggcaccggcgagguggcgacauucacucugauugagcaggauggaucugccuacguccccggugacagggcagcaccacucgguuaccccgauuucuccgggcaacuggagaucgagguccaaaccgagaccaccaagacuggagacaagcucaagguuaccaccuuugagaugguucuuggcccagagaccaacguggaucaggcccccuaccagggcaggguguacgccagcgucaacgcugcggccucccucgacuugguggauggcaggguucgcgcggucccaagauccgucuacaguuuccaagaugucaucccugaguacaacgacggguugcugguuccccuugcccccccaauuggccccuuucucccuggcgagguucucuugagguuccggaccuacaugcgucagauugacaccacugacgccgcagcagaggcaauagacugugcacucccccaggaguuugucuccugguucgcgucuaacgcguucaccgugcaguccgaggcccugcuccuuagguacaggaacacccugacugggcaacugcuguuugagugcaagcucuacagcgaagguuacaucgccuuguccuauucugguucaggagcccucaccuucccgaccgauggcuucuuugaggucgucagcugggucccccgucuuuaucaauuggccucugugggaagcuuggcaacaggccgaacacucaaacaauaa

SEQ ID NO: 6704 - RNA, 1623 nt, Artificial Sequence
  major_capsid_protein_VP1__Norovirus__AGJ52172
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguuuacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguggcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6705 - RNA, 1623 nt, Artificial Sequence
  major_capsid_protein_VP1__Norovirus__AGJ52173
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaacuucuaucauuacaaccaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacggguccuagcagugccuuuguuguccaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuuguaaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcaguauaa

SEQ ID NO: 6706 - RNA, 1623 nt, Artificial Sequence
  major_capsid_protein_VP1__Norovirus__AGJ52174
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccaucuggccagaauguauaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcagcuucucuucuucagauccaccaugcccggauguagcggguaccccaacauggauuuggacugucugcucccccaggaaugggugcaguacuucuaccaagaggcagccccagcacaaucugauguggcucugcuaagauuuguaaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgugcacuauaa

SEQ ID NO: 6707 - RNA, 1632 nt, Artificial Sequence; identical to SEQ ID NO: 5411
  major_capsid_protein_VP1__Norovirus__AGJ52176

SEQ ID NO: 6708 - RNA, 1608 nt, Artificial Sequence
  major_capsid_region__Norovirus__ADO85555
augaagauggcgucgaaugacgccgcuccaucuaaugauggugcagccggucucguaccagaggucaacaaugagaccauggcccuugaaccgguggcuggggcuucaauagccgccccacucaccggucaaaauaauguuauagaccccuggauuagauuaaacuuugugcaggcucccaauggagaguuuacaguuucaccccgcaauucgccuggggaaguccugcuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaaccauggaugaggcuuguggcaaugcucuauaccccccuuagaucuaaugguucuggugaugauguauuuacugucuccuguagagugcuuacucgacccucuccugauuuugauuucaauuauuugguacccccuacaguugaaucuaaaacuaaacccuucacacucccuaucuugaccauaggggaguuaaccaauuccagauucccugugccuauagaugaacucuauacuagccccaaugagaguuuggugguacaaccccagaacgggagaugcgcgcuggacggggaguugcaggguacuacucagcuccuccccacggcgaucugcucguucaggggucggauuaaucagaaagugaguggagagaaucauguuuggaauaugcaagucaccaacauuaacggaaccccuuuugauccaacagaggauguuccagcuccucuagguacaccagacuuuucuggcaagcucuuuggcgucuuaagccagagggaccaugauaaugcauguaggagccaugaugcagugauugcaacuaauucugcuaaauuuaccccaaaauugggcgcuauacaaauaggcacaugggaagaaaaugauguacacaucaaccaacccaccaaguuuacuccaguuggcuuguucgaaagugaagguuuuaaucaguggacacucccuaauuauucuggagccuugacacucaauaugggguuggcccccccuguggcccccacauuuccuggugagcaaauucuuuucuucagaucccacauuccucucaaaggagguguggcagacccaguuauugauugucucuugccccaagaguggauccaacaccuuuaccaggagucagccccuucacaaacagauguagcacugaucaggauuacaaauccagacacagggcguguccuauuugaagcaaaauugcacaggaguggcuacaucacaguggccaauacugguagcagaccaauuguggugccagcuaaugguuacuucagguuugacucuuggguuaaucaguuuuauucucucgcccccaugggaacugggaauggacgcagaagggugcaguaa

SEQ ID NO: 6709 - RNA, 1626 nt, Artificial Sequence
  majore_capsid_protein__Norovirus__AFO84035
augaggaugagugauggcgcagcgccaaaagccaacggcucugaagccagcggccaggaucuuguuccuaccgccguugaacaggccguccccauucagcccguggcuggugcggcucuugccgcccccgccgccgggcaaauuaaccaaauugaccccuggaucuuccaaaauuuuguccagugcccccuuggugaguuuuccauuucaccucgaaacaccccaggugaaauauuguuugauuuggcccucgggcccgggcucaacccuuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcgcccuggagcccauucaacucccucuucuugacgugcgucgaguucuuuggcaugcuacccaggaucaagaggaaucuaugcgccugguuugcaugcuguacacgccacuccgcacaaacagcccgggugaugagucuuucguggucucuggccgccuucuuucuaagccggcagcugauuucaauuuuguauaccugaccccucccaucgagagaaccauuuaucggaugguugacuugcccguguugcagccgcggcugugcacgcacgcucguuggccagccccggucuauggccucuugguugacccaucccucccaucgaacccccaguggcagaauggaagagugcauguugauggaacccuccuuggcacaacaccugucuccgguuccuggguuuccugcuuugcagcugaggccgcuuacgaguaccagucugagguuggugagguggcaaccuucacucugauugagcaggauggauccgccuacguccccggcgacagagcggcuccccuuggguaccccgacuacuccgggcagcuggagaucgaggugcagacugagaccaccaagacaggagacaagcuuaaggucaccaccuuugacaugauccuuggccccaccaccaacguggaccagguccccuaccaggguaagguguacgcgagccugacgaccgcgucuucacuugaccugguggaugggagagccagggcagucccccgcucugucuacuccuuccaggaugugcuuccagaguacaaugauggucuuuuggucccccuugccccgcccuuaggccccuaccuaccuggugagguucugcugagguuucggaccuacaugcgccagcuugacaccgcugacgccgcagcgcagccgaucgacugugccuugccucaggaauucaucuccugguuugcaagcaacaacuucacgguccaaucggaugcgcucuugauuagguaucgaaauaccuugacuggccagcuccuguuugaggcuaagcuuuauagcgaaggcuacauugcugugucuuauucggguuccggcccccucaccuuccccacugacggcuucuucgagguugucagcugggucccccgacucuuucaauuggccucugugggaagcuugguaacaggccgaacacucaaacaauaa

SEQ ID NO: 6710 - RNA, 1623 nt, Artificial Sequence
  major_viral_capsid_protein__Norovirus__AFN09918
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaacaauuuuguacaagccccugguggagaguuuacaguauccccuagaaacgcuccaggugaaauauuauggagcgcacccuugggcccugauuugaaucccuaccucucccacuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaacuggaaccuguguugaucccccugccugauguuaggaauaauuuuuaucauuacaaccaaucaaaugaccccaccaucaaauugauagcaaugcuguauacaccacucagggcuaacaaugcuggggacgaugucuucacagucucuugucgaguucucacgagaccauccccugauuuugauuucauauuucuggugccacccacaguugagucaagaacuaaaccauucucugucccaaucuuaacuguugaggagaugaccaauucaagauucccuauuccucuggaaaaguuguucacgggucccagcagugccuuuguuguucagccacaaaauggcagaugcacgacugauggcgugcucuuagguacuacccaauugucuccugucaacaucugcaccuucagaggggaugucacccacauugcagguacucaaaauuacacaaugaaucuggccucucaaaauuggaacaauuaugacccaacagaagaaaucccagccccucugggaaccccagauuuuguaggaaagauccaaggcgugcucacccaaaccacaaguagggauggcucgacccgcggucacaaagccacagugagcacuggaaguguccacuucaccccaaagcugggcaguguccaguucuccacugauacaagcaaugauuuugaaacuggccaaaacacgagauucaccccagucgguguuguccaggaugguaguaccacccaccaaaaugaaccccaacaaugggugcucccaaacuauucagguagagauagucacaauguacaccuagccccugccguggcccccacuuucccgggugagcaacuccuuuucuuuagguccacuaugcccgggugcagcggguaucccaacaugaauuuggauugccuacucccccaggagugggugcaacacuucuaccaagagucagcuccagcacaaucugauguggcacuguugagauuugugaauccagacacagguagggucuuguuugagugcaagcuucauaaaccaggcuauguaacaguggcucacacuggccaacaugauuugguuaucccccccaauggcuauuuuagauuugauuccugggucaaccaauucuacacacuugcccccaugggaaauggagcggggcguagacgugcauuguaa

SEQ ID NO: 6711 - RNA, 1623 nt, Artificial Sequence
  major_viral_capsid_protein__Norovirus__AFN09921
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugacuaauucaagauuccccauuccuuuggaaaaguuguucacgggucccaguggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6712 - RNA, 1623 nt, Artificial Sequence
  major_viral_capsid_protein__Norovirus__AFN09924
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugacuaauucaagauuccccauuccuuuggaaaaguuguucacgggucccaguggugccuuuguuguucaaccgcaaaauggcagaugcacgacugauggcgugcuccuaggcaccacccaacugucuccugucaacaucugcaccuucagaggggaugucacccacauugcagguucucgugacuacacaaugaauuuggcuucucuaaauuggaacaauuaugacccaacagaagaaauuccagccccucuaggaacuccagauuucgugggaaagauccaaggugugcucacucaaaccacaaagggaaauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuauaucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6713 - RNA, 1623 nt, Artificial Sequence
  major_viral_capsid_protein__Norovirus__AFN09927
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccgaauuuuccaacugaaggcuugagucccagccaggucacuauguucccccacauaauaguagauguuaggcaauuggaaccuguguugauccccuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaagucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6714 - RNA, 1623 nt, Artificial Sequence
  major_viral_capsid_protein__Norovirus__AFN09930
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguaucaccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuuuagaggggaugucacccacauugcagguucucguaauuacacgaugaauuuggcuucucuaaauuggaacaauuaugacccaacagaagaaauuccagccccucuaggaacuccagauuucgugggaaagauccaaggugugcucacucaaaucacaaagggagauggcucgacccguggccauaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaaugugcaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauuaagauuuguaaauccagacacggguaggguccuguuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6715 - RNA, 1623 nt, Artificial Sequence
  major_viral_capsid_protein__Norovirus__AFN09933
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccauccccugauuuugauuucauauuuuuggugccaccuacaguugagucaagaacuaaaccauuuacugucccaaucuuaacuguugaagaaaugaccaauucaagguuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauga

SEQ ID NO: 6716 - RNA, 1623 nt, Artificial Sequence
  major_viral_capsid_protein__Norovirus__AFN09936
augaagauggcgucgaaugacgccaacccaucugauggguccgcagccaaccucgucccagaggucaacaaugagguuauggcuuuggagcccguugucggugccgcuaucgcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugacuaauucaagauuccccauuccuuuggaaaaguuguucacgggucccaguggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6717 - RNA, 1623 nt, Artificial Sequence
  major_viral_capsid_protein__Norovirus__AFN09939
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuuuuaucacuauaaucagucaaaugauucuaccauuaaauugauagcaauguuguauacaccacuuagggcuaauaaugcuggggaagaugucuucacagucucuugucgaguucucacgaggccauccccugauuuugauuuuauauuuuuggugccaccuacaguugagucaagaacuaaaccauucacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6718 - RNA, 1623 nt, Artificial Sequence
  major_viral_capsid_protein__Norovirus__AFN09942
augaagauggcgucgaaugacgccaacccaucugauggguccgcagccaaccucgucccagaggucaacaaugagguuauggcuuuggaacccguugucggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6719 - RNA, 1623 nt, Artificial Sequence
  major_viral_capsid_protein__Norovirus__AFN09945
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaauccuuaccuaucucauuuggccagaauguauaaugguuaugcaggugguuuugaagugcaggugauccucgcggggaacgcguucaccgccggaaaaauuauauuugcagcagucccaccaaauuucccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccuuccccugauuuugauuuuauauuuuuggugccaccuacaguugagucaagaacuaaaccauuuacugucccaaucuuaacuguugaagaaaugaccaauucaagauucccuauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucauaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguggaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaacccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6720 - RNA, 1623 nt, Artificial Sequence
  major_viral_capsid_protein__Norovirus__AFN09948
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugggccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagguuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6721 - RNA, 1623 nt, Artificial Sequence
  major_viral_capsid_protein__Norovirus__AFN09951
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugacuaauucaagauuccccauuccuuuggaaaaguuguucacgggucccaguggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccaugggaaauggaacggggcguagacgugcuuuauaa

SEQ ID NO: 6722 - RNA, 1623 nt, Artificial Sequence
  major_viral_capsid_protein__Norovirus__AFN09954
augaagauggcgucgaaugacgccaacccaucugauggguccgcagcuaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugaucccuuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccauccccugauuuugaucuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgaccgauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagguuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6723 - RNA, 1623 nt, Artificial Sequence
  major_viral_capsid_protein__Norovirus__AFN09957
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcuuccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagguuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcuuuauaa

SEQ ID NO: 6724 - RNA, 1623 nt, Artificial Sequence
  major_viral_capsid_protein__Norovirus__AFN09960
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguccucacgaggccuuccccugauuuugauuuuauauuuuuggugccaccuacaguugagucaagaacuaaaccauuuacugucccaaucuuaacuguugaagaaaugaccaauucaagauucccuauuccuuuggaaaaauuguucaggggucgcagcagugcucuuguuguucauccacaaaauggcagaugcacgacugauggcgugcucuuaggcaccacccaacugucuccugucaacaucugcaccuucagaggggaugucacccacauugcagguucucauaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaacgagccccaacaaugggugcucccaaguuauucagguggaaauguccauaauguacaccuagccccugcuguagcccccacuuuuccgggugaacaacuucuuuucuucagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugaguacaaacuucauaaaucagacuaugucacaguggcucacaccggucagcaugauuuggucaucccccccaaugguuauuuuagguuugauucauggguuaaucaauucuacacacuugccgccaugggaaauggaacggggcguagacgugcuuuauaa

SEQ ID NO: 6725 - RNA, 1623 nt, Artificial Sequence
  major_viral_capsid_protein__Norovirus__AFN09963
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuuuuaucacuauaaucagucaaaugauucuaccauuaaauugauagcaaugcuguauacaccacuuagggcuaauaaugcuggggacgaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugccuccuucacuccaaagcugggcaguguucaauuuaguacugauacagaaaaugauuuugaaacucaccaaaacacaaaauucaccccagucggugucauccaggauggcagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6726 - RNA, 1623 nt, Artificial Sequence
  major_viral_capsid_protein__Norovirus__AFN09966
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuagguccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugacuaauucaagauuccccauuccuuuggaaaaguuguucacgggucccaguggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccgggugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacgugcauuauaa

SEQ ID NO: 6727 - RNA, 1623 nt, Artificial Sequence
  major_viral_capsid_protein__Norovirus__AFN09969
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguggauguuaggcaauuggaaccuguguugauccccuuaccugauguuaggaauaacuucuaucauuauaaucaaucaaaugauucuaccauuaaguugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguggcaccacccaccgaaaugaaccccaacaaugggugcucccaaguuauucagguagagaugucccuaaugugcaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6728 - RNA, 1623 nt, Artificial Sequence
  major_viral_capsid_protein__Norovirus__AFN09972
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggggaguucacaguauccccuagaaacgcuccaggugaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucaccauguucccccacauaauaguagauguuaggcaauuggaaccuguguugauccccuuaccugauguuaggaauaacuucuaucauuauaaucagucaaacgauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaauuacacaaugaauuuggcugcucugaauuggaacaauuaugacccaacagaagaaauuccagccccucuaggaaccccagauuucgugggaaagauccaaggugugcuuacucaaaccacaaaggcagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccaccuucccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacgugcuuuauaa

SEQ ID NO: 6729 - RNA, 1593 nt, Artificial Sequence
  major_viral_capsid_protein__Norovirus__AFN09975
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugacuccaccaucaaauugauagcaauguuguacacaccacuuagggcuaauaaugccggggacgaugucuucacaguuucuugucgaguucucacgagaccauccccccgauuugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguaccacccaacugucuccugucaacaucugcaccuucagaggggaugucacccauauuccaggcagucguaacuacacaaugaauuuggccucccaaaauuggaacaguuacgguccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcaggaacauucacaaugugcaccuggcccccgcuguagcccccacuuucccgggcgagcagcuccucuuuuucagaucuacuaugcccggaugcaguggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6730 - RNA, 1623 nt, Artificial Sequence
  major_viral_capsid_protein__Norovirus__AFN09978
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccuuguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguaccacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcaggaacauucacaaugugcaccuggcccccgcuguagcccccacuuucccgggcgagcagcuccucuuuuucagaucuacuaugcccggaugcaguggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacgugcauuauaa

SEQ ID NO: 6731 - RNA, 1623 nt, Artificial Sequence
  major_viral_capsid_protein__Norovirus__AFN09981
augaagauggcgucgaaugacgucaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucuaaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaagguuugagucccagccaggucacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuucauauuuuuggugccacccacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaacgguuauuuuagguuugauuccuggguuaaucaauucuacacacuugcccccaugggaaauggaacggggcguagacgugcuuuauaa

SEQ ID NO: 6732 - RNA, 1623 nt, Artificial Sequence
  major_viral_capsid_protein__Norovirus__AFN09984
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaacaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuauguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6733 - RNA, 1623 nt, Artificial Sequence
  major_viral_capsid_protein__Norovirus__AFN09987
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccaccaucaaauugauagcaaugcuguacacaccacuuagggcuaauaaugcuggggacgaugucuucacaguuucuugucgaguucucacgagaccaucccccgauuuugauuucauauuuuuggugccaccuacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccacauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaaccaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccaccuucccgggcgagcagcuccucuucuucagaucuacuaugcccggaugcagcggguaccccaacauggauuuggacugccugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugacuccugggucaaccaguucuacacacuugcccccaugggaaaugggacggggcguagacgugcauuauaa

SEQ ID NO: 6734 - RNA, 1623 nt, Artificial Sequence
  major_viral_capsid_protein__Norovirus__AFN09990
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccaccaucaaauugauagcaaugcuguacacaccacuuagggcuaauaaugcuggggacgaugucuucacaguuucuugucgaguucucacgagaccaucccccgauuuugauuucauauuuuuggugccaccuacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaaccaaccaaaacacaaaguucaccccagucgguguuauccaggaugguagcaccaccccccgaaaugaaccccaacaaugggugcucccaaguuacucaggcagaaacauucauaaugugcaccuggcccccgcuguagcccccaccuucccgggcgagcagcuccucuucuucagaucuacuaugcccggaugcagcggguaccccaacauggauuuggacugccugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugacuccugggucaaccaguucuacacacuugcccccaugggaaaugggacggggcguagacgugcauuauaa

SEQ ID NO: 6735 - RNA, 1623 nt, Artificial Sequence
  major_viral_capsid_protein__Norovirus__AFN09993
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauucccuuacccgauguuaggaauaauuucuaucauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacgacaggugcacgacugauggcgugcuccuagguacuacccaacugucucccgucaacaucugcaccuucagaggggaugucacccauauuccaggcagucguaacuacacaaugaaucuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaguguacaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagguuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6736 - RNA, 1623 nt, Artificial Sequence
  major_viral_capsid_protein__Norovirus__AFN09996
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauucccuuacccgauguuaggaauaauuucuaucauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaaucuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaauguacaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagguuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6737 - RNA, 1623 nt, Artificial Sequence; identical to SEQ ID NO: 6727
  major_viral_capsid_protein__Norovirus__AFN09999

SEQ ID NO: 6738 - RNA, 1623 nt, Artificial Sequence
  major_viral_capsid_protein__Norovirus__AGC96529
augaagauggcgucgaaugacgccaacccaucugauggguccgcagccaaccucgucccagaggucaacaaugagguuauggcuuuggagcccguugucggcgccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaauuuuccaacugaaggcuugagccccagccaggucacuauguucccccacauaauaguggauguuaggcaauuggaaccuguguugauccccuuaccugauguuaggaauaacuucuaucacuauaaccaaucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaaccaaaccauuuacugucccaaucuuaacuguugaggaaaugaccaauucaagauuccccauuccuuuggaaaaguuguucacgggucccagcagugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguaugcucacucaaaccacgaaaggagaugguucgacccguggccauaaagcuacaguuuauacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaagcuauucagguagagauaucccuaauguacaccuagccccugcuguagcccccacuuucccgggugaacaacuucuuuucuuuaggucuacuaugcccggaugcagcggguaucccaacauggauuuggauugccugcucccccaggagugggugcagcacuucuaccaagaggcagcuccagcacaaucugauguggcucuauugagguuugugaauccagacacgggcaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacgugcuuuauaa

SEQ ID NO: 6739 - RNA, 1623 nt, Artificial Sequence
  major_viral_capsid_protein__Norovirus__AGC96532
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaacuucuaccauuauaaucaaucaaaugacuccaccaucaaguugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaccccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaguuugccacugacacagacaaugauuuugaaacuaaccaaaacacaaaguucaccccagucgguguuauccaggaugguaguacuaccccccgaaaugaaccccaacaaugggugcucccaaguuacucaggcagaaauauucauaaugugcaccuggcccccgcuguagcccccacuuucccgggcgagcagcuucucuucuuuagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacgugcauuauaa

SEQ ID NO: 6740 - RNA, 1644 nt, Artificial Sequence
  major_viral_capsid_protein__Norovirus__AGC96535
augaagauggcgucgaaugacgcugcuccaucgaaugauggugcugccaaccucguaccagaggccaacaaugagguuauggcacuugaaccgguggugggagccucaauugcagcuccugucgucggucaacagaauauaauugaccccuggauuagagaaaauuuuguucaggcaccacagggugaguuuacuguuucaccaagaaacucgccuggugagaugcuuuuaaaucuugaauuaggcccagagcucaauccuuacuugagucauuugucccgcauguacaaugguuaugcugguggcaugcagguucaggugguccuagcugggaaugcguucacagcugguaaaaucaucuuugccgccguuccaccacauuucccuguagagaauauuagugcagcucaaauuacaaugugcccccaugugauuguugaugugagacagcuugaaccugugcuuuugccccucccugacauaaggaacagauucuuucauuacaaccaggaagacaccccccggaugagacuuguggccauguuguacacaccucuuagagcaaacucuggugaggacguguucacugugucuugcagagucuugacccgcccagccccugauuuugaguucacauucuuagugccaccaaccguggaaucaaagacuaagccuuuuacacucccuauuuuaacccuaggggaacuauccaauuccagauucccugcuccaauagacaugcuguacacagauccuaaugagacaauugugguacaaccacaaaaugguagaugcacccuagaugggacacuccaagggaccacccagcuggugcccacccaaauuugcucuuuuaggggcacguugaucagccaaacgucgaggucagcagauucaacagacucagcuccacgggugaggaaccacccccuucacguucagcugaagaaccucgacgggacaccauaugacccaacagaugaggugccggcaguucugggugccauagacuuuaaaggaacuguguuuggagucgcuagccagaggaacacuacagggagcucuguaggggcgacucgugcccaugaggugcacauagacaccacaaacccuagauacaccccaaaacuugguucuguguugaugcauucugagucuagugauuuugaugauggacaaccaacccgcuucacacccauuggcaugggagcagaugauuggcaccaaugggaauugcccgaauauucaggucaccuuacucucaacaugaaccuagccccugcaguugcuccugcuuuccccggugagcgcauccucuucuuuaggucagugguuccaucugcugguggcuacggaucaggccaaauagacugccucaucccacaggaguggguucagcacuucuaucaggaggccgccccuucacaaucugcgguggcucuuauuagauauguuaacccugacacugggagaaacaucuuugaggcaaagcuacacagagaaggguucauuacuguggcaaauucuggaaacaaccccauaguugugcccccgaauggcuauuuuagguuugaggccugggucaaucaauucuacacacucacccccaugggaacuggacaggggcgcaggagaguccaauaa

SEQ ID NO: 6741 - RNA, 1623 nt, Artificial Sequence
  major_viral_capsid_protein__Norovirus__AGS16690
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucaaucaaaugauucuaccauuaaguugauagcaaugcuguauacaccacuuagggcuaauaaugcuggggaagaugucuucacagucucuugucgaguccucacgaggccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagcuccucuaggaacuccagauuucgugggaaagauccaaggugugcucacucaaaccacuaagggggaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaauuauucagguagugaugucccuaauguacaccuagccccugcuguagcccccaauuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugaauguaaacuccauaaaucaggcuaugucacaguggcucacaccggccagcaugauuuggucaucccccccaaugguuauuuuagguuugauuccuggguuaaucaauucuacacacuugcccccaugggaaauggaacggggcgcagacgugcuuuauaa

SEQ ID NO: 6742 - RNA, 1623 nt, Artificial Sequence
  major_viral_capsid_protein__Norovirus__AGS16693
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucaaucaaaugauucuaccauuaaguugauagcaaugcuguauacaccacuuagggcuaauaaugcuggggaagaugucuucacagucucuugucgaguccucacgaggccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagcuccucuaggaacuccagauuucgugggaaagauccaaggugugcucacucaaaccacuaagggggaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaauuauucagguagugaugucccuaauguacaccuagccccugcuguagcccccaauuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugaauguaaacuccauaaaucaggcuaugucacaguggcucacaccggccagcaugauuuggucaucccccccaaugguuauuuuagguuugauuccuggguuaaucaauucuacacacuugcccccaugggaaauggaacggggcgcagacgugcuuuauaa

SEQ ID NO: 6743 - RNA, 1623 nt, Artificial Sequence; identical to SEQ ID NO: 6668
  major_viral_capsid_protein__Norovirus__ALM98919

SEQ ID NO: 6744 - RNA, 1623 nt, Artificial Sequence
  major_viral_capsid_protein__Norovirus__ALM98922
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggaucagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguagaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucaagguucccaguccccaucgauucgcuuuucaccgcccagaauaacguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6745 - RNA, 1623 nt, Artificial Sequence; identical to SEQ ID NO: 6668
  major_viral_capsid_protein__Norovirus__ALM98928

SEQ ID NO: 6746 - RNA, 1623 nt, Artificial Sequence
  major_viral_capsid_protein__Norovirus__ALM98931
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcucagaucacaaugcucccacauuuaauaguagauguuaggacucuugaaccaauuaugaucccacucccugauguuaggaauacauucuuccauuauaguaaccagccuaauagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaauugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugacaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacauuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6747 - RNA, 1623 nt, Artificial Sequence
  major_viral_capsid_protein__Norovirus__ALM98934
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcaggugcacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugacgcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggggacuauccucuuguuguuccggcuaauggacacuuuagauuugauucuuggguaaaucaguuuuacucacucgccccaaugggaacugggaaugggcgaaggagggcucaguaa

SEQ ID NO: 6748 - RNA, 1623 nt, Artificial Sequence
  major_viral_capsid_protein__Norovirus__ALM98940
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggccccgauuugaacccuuauuuggcucauuuaucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugauguuuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuguagauugucucauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcguaggagggcucaguaa

SEQ ID NO: 6749 - RNA, 1623 nt, Artificial Sequence; identical to SEQ ID NO: 6746
  major_viral_capsid_protein__Norovirus__ALM98943

SEQ ID NO: 6750 - RNA, 1623 nt, Artificial Sequence
  putative_capsid_protein__Norovirus__ABD73936
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucugaaucccuaccuuucucauuuagccagaauguacaauggcuaugcagguggcuuugaagugcagguaauccuugcggggaaugcguucaccgccgggaaaaucauauuugcagcagucccaccaaauuucccaacugaaggcuuaagccccagccaggucacuauguucccccauguaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuaguggugccuuuguuguucaaccacaaaauggcagguguacgacugauggcgugcucuuaggcacuacccaacugucuccugucaacaucugcaccuucagaggggaugucacccauauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucaccccaaagcugggcaguauucaguucaacacugauacaaacaaugauuuugaaacuggucaaaacacgaaauucaccccagucgguguuguccaggaugguaaugguacccaccaaaaugaaccucaacaaugggugcucccaagcuacucagguagaacuggccauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugacuccugggucaaccaauucuacacacuugcccccaugggaaaugggacggggcguagacgugcauuauaa

SEQ ID NO: 6751 - RNA, 1560 nt, Artificial Sequence
  structural_capsid_protein__Norovirus__ABY67257
augaagaugacugacaaggacacgcaggaagcggcuccggcccuuggccaaguccucccccccgagguugagguggccauccccguugagcccacugcgggggcgcagaucgcugccccuacugcuggacaagucaacccuauugacccauggauuuuugcaaauuuugugcaggccccccagggcgaauucaccaucuccccaaauaauaauccuggagaaguucuuuuugaacuggagcucggcccggagcugaacccauaccuggcccacuugcgccagauguauaacggguggacuggguccauucgagucaaggugauccuggccgggaaugcuuuuucagcuggaaagauuauaguuuucuguauuccuccugguuuugaugcuuccuaucucacuccuuuucaggccacucaguucccucauguaauaauggauguccgcgcugcggagccaauugaaaucccccuugcugaugugcgcaaugugcuuuuucaucagggcccagauucccggaugcggcugaugggcaugcuuuacaccccgcuccgugcuaauucuggugcagacccguuugucguaacggggaggguucuuaccuguccaaguccagauuuuucuuucuucuuuuugguuccccccacuguagaggagcggagcacccccuuuuccguuccgaauguuccagucuacagccucaccaauucccgugccccgguucccaucuaugagcuccguagcucccgcucuuugccuuugacggugcaguuccaaaauggucgcuguacuguggagggcgauuugcuuggcaccacuccuuuuucugcuggugaucugugcucuuuuauguguauucguggggauacccagcacauagccgaauuguuggaacccgaugaaucggcuuuuguuguuggggagcgcccagccacgcuugguuuuccagauuuuucucaguguguucuucaucuuuugcuugccgauggcacuggcauuuggcaccagagccuugacgugaagaauccacaacacuucaccccagccaucggccagguuguguugucuggagaugugccauugacccggacucggguccgcuuggauuauguuuugucuacuucuagggacucuuucugggugcugccugauuaucguucugaugugcuuggcucugaguuugccccugccguuucugcgccuggggugggcgagacccuucucuuuuucauggggagggcgcccguucaaggcccuuccaacccucuuccgugccugcuucccuuggaaugggucuuccauuucgcuucagaacggccuaccaaacagagugauguggcgcugcuuaacuacgucaacccggacaccggucguguccuuuuugaagcgaaacucuacucuucuggauuucucacagugaauuuggggacugcuaaugaggugguucugcccaccaguggcaucuucaaguuugccucuuggguuucucuuuacuaucagcuucggcccgugggaacgcugagugcuggccgccgccucccccgagucgauggcuacuga

SEQ ID NO: 6752 - RNA, 1653 nt, Artificial Sequence
  viral_capsid_protein__Norovirus__AHA91656
augaugauggcgucuaaggacgcuaccucaaacauggauggcaccagcggagcuggacagcuggugccagagaauaauaacaccucagaaccaaucaacauggaaccagucgcgggcgcgguuacugccgcagcuacggcuggccaggugaauaugauugauccuuggauaaugaauaauuauguacaagccccccagggcgaguucacaauuucgcccaauaauacuccuggugauauauuguuugaucuucaauuagguccccaucugaaccccuuucuugcucauuuaucccaaauguauaauggauggguugguaacaugaaagucagggugguguuggcuggcaaugcuuuuucugcgggaaagaucauagugugcuguauaccaccuggauucucugcaccaaacauauccauagcccaggcaacuauguucccucauguuauugcugauguucgggucuuggagcccauugauauuccccuugaugaugucaggaauguucuguuucauaauaaugauaaugguaaucagacuaugagauugcugugcauguuguauacaccacuccguaguggaggcacauccaguggaacugacccguuugugauugcugguaggguucuaaccugcccuacuccagauuuuaauuucuuguucuugguucccccaaccguugagcaaaagaccaaacaguuuagugugccuaaccuuccccucaauguuaugucuaauucuagaguuccaucacuccuaaaugcuaugguggugucaccagaucaggcccaaguggugcaauuucaaaauggcaggugcacccuugaugggcaaauguugggcaccaccacuguaucagcuagcuguguugcaagauucagagggaaaacuuuucaagccccugacaacagguuagguaucaaucuggcugaaauuaguggagaaccauaccaugcauuugaaagcccugccccccuagguuucccugacuuuggggauggagauuggcacgucacugcaacaaaaguaacccccucacagcuugaggcuaaugacccuguggucauggggaauguccaaccauauaacccacaguuugccccucaccugggcacccuagucguagaaaacccuacuccagacaaugugaccaccgggacugacuuauuguucaacauaaccuggcuuuccaaucgugccaauaaucgguuuaacccuuggguuaucccaaauuaugguucaacucucacugaggcagcacagcuggcaccuucaauauuucccccuggcuuuggugaaacuauaguguauuucaauuccacuuuuccagcugugggggccaccacccaugcagcuauacccugucugcuuccacaagaauuuguugcucauuuuguuaaugaacaggcccccauacguggagaggcugcuuugcuccacuacauugacccugauacucaccguaaucuuggugaguucaaaauuuauccagagggcuuuguaacguguguuccuaauguggguggcacggggccacaaucucuaccuacuaaugguaucuuugucuuugucucuugggugucaagguacuaucaacucaagccugugggaacugcuggucaagcaaggcggcuugguuucaggagaguauaa

SEQ ID NO: 6753 - RNA, 1629 nt, Artificial Sequence; identical to SEQ ID NO: 4817
  VP1_capsid_protein__Norovirus__BAL60747

SEQ ID NO: 6754 - RNA, 1629 nt, Artificial Sequence
  VP1_capsid_protein__Norovirus__BAL60751
augaagauggcgucgaaugacgccgcuccaucuacugauggugcagccggccucgugccagaaaguaauaaugaggucauggcucuugaacccguggcuggcgccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcugugccaccucacuucccgguugaaaaccuuaguccacagcaaauuaccauguucccucaugugauuauagauguaaggacuuuggaaccuguuuuauuaccacucccugauguuagaaacaauuucuuccauuauaaucagaaagaugaucccaagaugagaauuguggcuaugcuuuauaccccccucaggucuaaugguucaggugaugauguguuuacagucuccugcaggguguugacuagacccuccccugauuuugauuucacauaucuggugccaccaacaguggagucuaaaacaaaaccauuuacccucccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccauuugcaugacaaugaucaucuauauaaugucaccaucacaaacuugaaugggucccccuuugaccccuccgaggacaucccugccccucugggcguaccugacuuucagggaaggguuuuuggugucaucucccaaagagacaaacacaauuccccuggacauaaugaaccagcaaauagggggcacgacgcuguggucccuacuuacacaucacaguacacuccaaaauugggucagauucaaauuggcacauggcaaaccgaugaucuuacagucaaccaaccagucaaauucaccccaguugggcucaaugacacugaacauuuuaaccaaugggugguccccagauaugcuggugcucuaaaccuuaacacaaaccuugccccuucuguugcuccaguauuuccaggggagcgccugcucuuuuucagaucauacaucccccucaagggugguuauggaaauccagccauugauugccuacuaccacaagagugggugcagcauuucuaucaggaagcagccccuucaaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggguucaauaa

SEQ ID NO: 6755 - RNA, 1629 nt, Artificial Sequence
  VP1_capsid_protein__Norovirus__BAL60763
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaagucauguuggcugggaacgcguucacagccggcaaguuggucuucgccgcugugccaccucacuucccgauugaaaaccuuaguccacagcaaauuaccauguuuccucaugugauuauagauguaaggacuuuggaacccguuuuauuaccacucccugauguuagaaauaauuucuuccauuauaaucagaaagaugaucccaagaugagaaucguggcuaugcucuacaccccccuuaggucuaaugguucaggugaugauguauucacagucuccugcaggguguugacuagacccuccccugauuuugauuucacauaucugguaccaccaacaguggaaucuaaaacaaaaccauucacccucccaauccucacacuuggggaacuuuccaauucuagauucccaguguccauagaccagauguacaccagccccaaugaagucauaucagugcagugucagaaugguaggugcacgcuggauggggagcuccaaggaacaacacaacuccaagucaguggcauuugugcuuuuaagggagaaguaaccgcccacuugcaugauaaugaucaccuauacaauaucaccaucacaaacuugaauggguccccuuuugaucccuccgaggacaucccugccccccugggcguaccugacuuucagggaagggucuuugguaucaucucccaaagagacaagcacaauuccccuggacauaaugaaccagcaaauaggggacacgacgcuguggucccuacuuacacagcacaguacacuccaaaauugggucagauucaaauuggcacauggcagaccgacgaucucacagucagccaaccaguaaaguucaccccaguuggacucaaugauacugaacauuuuaaccaaugggugguuccuagauaugcuggugcucuaaaucuuaauacaaaucucgccccuucuguugcuccaguauuuccaggggagcgccugcucuuuuucagaucauauaucccccucaagggugguuauggaaauccagccauugauugccuacugccacaagagugggugcaacauuucuaccaggaagcagccccuucaaugagugagguggcccuugucagauacaucaacccggauacuggucgggcacuguucgaggccaagcuccacagagcugguuucaugacagucucaagcaacaccagugccccggugguugugccugccaacggauacuuuagauuugauucuugggugaaccaauucuauucucucgcccccaugggaacuggaaaugggcguagaagaguucaauaa

SEQ ID NO: 6756 - RNA, 1629 nt, Artificial Sequence
  VP1_capsid_protein__Norovirus__BAL60765
augaagauggcgucgaaugacgccgcuccaucuacugauggugcagccggccucgugccagaaaguaauaaugaggucauggcucuugaacccguggcuggugccgcuuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagaauguacaacggguaugccggugggauggaggugcaggucauguuagcugggaacgcguucacagccggcaaguuggucuucgccgcugugccaccucacuucccgguugaaaaccuuagcccacagcaaauuaccauguucccucaugugauuauagauguaagaacuuuggaaccuguuuuauuaccacucccugauguuagaaauaauuucuuccacuauaaucagaaagaugaucccaagaugagaauuguggcuaugcuuuacaccccccuuaggucuaauggcucaggugaugauguguuuacaguuuccugcaggguguugacuagacccuccccugauuuugauuucacauaucuggugccaccaacgguggaaucuaaaacaaaaccauucacccucccaauccuuacacuuggggaacuuuccaauucuagauucccaguguccauagaccaaauguacaccagcccuaaugaaguuauaucagugcagugucaaaaugguaggugcacauuggacggggagcuccaagggacaacacaacuccaagucaguggcauuugugccuucaagggagaagugaccgcccauuugcaugauaaugaucacuuauauaaugucaccaucacaaauuugaauggauccccuuuugaccccuccgaggacaucccugccccucugggcguaccugauuuucagggaagggucuuugguaucgucucccaaagagacaaacacaacagcccuggacauaaugaaccagcaaacaggggacacgaugcuguggucccuacuuacacagcacaguacacuccaaaauugggucagauucaaauuggcacauggcagaccgacgaucuuacagucaaccaaccagucaaauucaccccaguuggacucaaugauauugaacauuuuaaccaaugggugguccccagauaugcuggugcucuaaaccucaacacaaaccuugccccuucuguugcuccaguauuuccaggggagcgccugcucuuuuucagaucauacauuccccucaagggugguuauggaaauccagccauugauugccuacuaccacaagaaugggugcaacauuucuaccaggaagcagcccccucaaugagugagguggcccuugucagauacaucaacccggacacuggucgggcacuguuugaggccaagcuccacagagcugguuucaugacagucucaagcaacaccagugccccggugguugugccugccaauggauacuucagauuugauucuugggugaaccaauucuauucucucgcccccaugggaacuggaaaugggcguagaaggguucaauaa

SEQ ID NO: 6757 - RNA, 1629 nt, Artificial Sequence
  VP1_capsid_protein__Norovirus__BAL60787
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccaguuggacuuagugauacugaccauuuuaaccaaugggugguccccagguaugcuggugcccuaaaccuuaacacaaaccuugccccuucuguugcuccaguauuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggauccaauaa

SEQ ID NO: 6758 - RNA, 1629 nt, Artificial Sequence; identical to SEQ ID NO: 4840
  VP1_capsid_protein__Norovirus__BAL60789

SEQ ID NO: 6759 - RNA, 1629 nt, Artificial Sequence
  VP1_capsid_protein__Norovirus__BAL60807
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuacuauguucccucaugugauuauagaugucagaacuuuggaaccuguuuuacuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugacuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaacaccccuggacauaaugaaccagcaaacagggcacacgaugccguggucccuacuuacacagcacaguacaccccaaaauugggucagauccaaauuggcacauggcagacugacgaucucacagucaaccaaccagucaauuucaccccaguuggacuuaaugauacugaccauuuuaaccaaugggugguccccagguaugcuggugcccuaaaccuuaauacaaaccuugccccuucuguugcuccaguauuuccaggggagcgccugcucuuuuucagaucauacaucccccucaagggugguuauggaacuccagccauugauugccuacugccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaaggauccaauaa

SEQ ID NO: 6760 - RNA, 390 nt, Artificial Sequence
  capsid__Norovirus__ACL14997
auggcgucgaaugacgccgcuccaucuaaugauggugcagccggccucgugccagaaaguaacaaugagguuauggcucuugaaccuguugcuggggcaucuuuagcugccccugugacuggucaaacuaauauaauugacccauggauuagaaugaauuuuguucaagccccaaauggagaauucacuguuuccccaagaaauuccccuggagaaguacuccuaaauuuggaauuggguccugaauuaaacccuuaucuggcacaccuaucuagaauguauaaugguuaugcuggggguauggaggugcagaucaugcuagcugggaaugcguucacugcugguaaacugaucuucgcugcugugcccccauauaaucgucgauguuag

SEQ ID NO: 6761 - RNA, 561 nt, Artificial Sequence
  truncated_capsid_protein__Norovirus__ACB56490
augaagauggcgucaaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaugcaauuggaaccuguguugauccccuuaccugauguuaggaauaacuucuaucacuauaaucagucaaaugauucuaccauuaaauuugauagcaaugcuguauacaccacuuaa

SEQ ID NO: 6762 - RNA, 627 nt, Artificial Sequence
  truncated_capsid_protein__Norovirus__ACF77106
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucaccauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccuaucuccuga

SEQ ID NO: 6763 - RNA, 627 nt, Artificial Sequence
  truncated_capsid_protein__Norovirus__ACF77107
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccaucucccuga

SEQ ID NO: 6764 - RNA, 66 nt, Artificial Sequence
  truncated_capsid_protein__Norovirus__ACU28807
augaagauggcgucaaaugacgcccacccaucugauggguccgcagccaccucgucccagagguaa

SEQ ID NO: 6765 - RNA, 312 nt, Artificial Sequence
  truncated_capsid_protein__Norovirus__ACU28808
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaauggauaugcagguggauuauaa

SEQ ID NO: 6766 - RNA, 123 nt, Artificial Sequence
  truncated_capsid_protein__Norovirus__ACV03476
augaagauggcgucaaugacgccaacccaucugauggguccgcagccaaccucgucccagaggucaacaaugagguuauggcuuuggagcccguugucggugccgcuauugcggcgccuguag

SEQ ID NO: 6767 - RNA, 87 nt, Artificial Sequence
  truncated_capsid_protein__Norovirus__ACV03479
augaagauggcgucaaugacgccacuccaucuaaugauggugccgccggccucgucccagagaucaacaaugaggcaauggcgcuag

SEQ ID NO: 6768 - RNA, 1623 nt, Artificial Sequence
  capsid_protein__Norovirus__AFN70960.1
augaagauggcgucuaaggacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggccccgaucugaaucccuaccuuucucauuuggccagaauguacaauggcuaugcugguggcuuugaagugcagguaauccuugcggggaaugcguucaccgccgggaaagucauauuugcagcagucccaccaaauuucccaacugaaggcuugagccccagccaggucacuauguucccccauauaguaguagauguuaggcaacuggaaccuguguugauccccuuaccugauguuaggaacaauuucuaucacuacaaccaaucaaaugaccccaccauuaaacugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcagaugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggucacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguacccuaacaugaauuuggauugccuacucccccaagaaugggugcagcacuucuaccaagaggcagcuccagcacaaucugauguggcucugcuaagauuugugaauccagacacagguaggguucuauuugagugcaaacuucauaaaucaggcuaugucacaguggcucacacuggccagcaugauuuggucaucccccccaauggcuacuuuagauuugauuccugggucaaccaauucuacacacuugccccccugggaaaugggacggggcguagacgugcauuauaa

SEQ ID NO: 6769 - RNA, 1629 nt, Artificial Sequence
  VP1__Norovirus_and/or_Norovirus-like__X81879
augaagauggcgucgaaugacgccgcuccaucuacugauggugcagccggccucgugccagaaaguaauaaugaggucauggcucuugaacccguggcuggcgccgccuuggcagccccggucaccggucaaacaaauauaauagacccuuggauuagagcaaauuuuguccaggccccuaauggugaauuuacaguuucuccccgcaaugccccuggugaagugcuauugaaucuagaguuggguccagaauugaauccuuaucuggcacauuuagcaagaauguauaacggguaugccggugggauggaggugcaggucauguuggcugggaacgcguucacagccggcaaauuggucuucgccgcugugccaccucauuuuccggucgaaaaccuuaguccacagaaaauuaccauguucccccaugugauuauagauguaaggacuuuagaaccuguuuuauuaccacucccugauguuagaaauaguuucuuccauuauaaccaaaaagaugaucccaagaugagaauuguggcuaugcuuuacaccccccuuagguccaaugguucaggugaugacguguuuacagucucuugcaggguguugaccagaccuuccccugauuuugauuuuacauaccugguaccaccaacaguggaauccaaaacaaaaccauucacccuuccaauccucacgcuuggggagcuuuccaauucuagguucccagugcccauagaucagauguauacuagccccaaugaagucauaucugugcagugucagaauggaaggugcacgcuggauggggagcuccaaggaacaacacagcuccaagucaguggcauuugugcauucaaaggagaagugaccgcucacuugcaugacaaugaucaccuaaauaaugucaccaucacaaacuugaauggguccccuuuugaucccuccgaggacauccccgcccccuugggcgugccugacuuccaggggagagucuuuggugucaucucccaaagagacaaacagaaugccgcuggacacagugagccagcaaacaggggacacgaugcugugguucccacuuacacagcacaguacacuccaaaauugggucagauucaaauuggcacauggcagaccgacgaccuuacagucaaccaaccagucaaauucaccccaguuggucucaaugacacagaacauuuuaaccaguggguggucccuagauacgcuggugccuuaaaccuuaacacaaaucuugcccccucuguugcuccaguguuuccaggggagcgccugcucuucuucagaucacaccucccccuuaaggguggcuauggaaauccagcuauugauugucuacugccacaagagugggugcagcauuuuuaucaagaagcagcucccucaaugagugagguggcccuugucagauacaucaauccagacacuggccgggcgcuguuugaggccaagcuccacagagcugguuucaugacagucucaagcaacaccagugcuccggugguugugccugccaacggauacuucagguuugacucuugggugaaccaauuuuauucucucgcccccaugggaacuggaaaugggcguagaaggguucaguaa

SEQ ID NO: 6770 - RNA, 1728 nt, Artificial Sequence
  VP1__Norovirus_and/or_Norovirus-like__FJ875027
augaagauggcgucuaaugacgcugcacccccaucuucggauggggcagccaaccucgugccagagaucaacaaugagguuauggcuuuggaaccaguagccggcgcccaauuggcugcuccugucgccggccaguucaaugcaauugaucccuggauaagacaaaauuuuguucaagcaccugaaggugaguucacuguuuccccccggaacgcuccgggcgaaauucuacugaacuuggaauuggggccacaucucaaccccuuucugcaacaccuugcucagauguacaaugccuaugcugguggcauggaggugcaaguuguccuugcggggaacgcguucaccgcuggaaagaucauauuugcugccauacccccgcauuuuccgccugagagacucucugcagcgcaagccacacaauuuccccaugugauaguugaugugagacagcuugagcccauagucuugccucuuccggaugucaggcauaacuuguuccauuucaaucagcagaaugaugaaaggaugcaucuagucgccuuccuguacaccccccugcgagcgaauucugggaauggugaugauguauucacaguguccugccgggucuugacccgacccucccaagacuuugaguucauguucuuggucccgcccacgguugaaaagaaaacgguggcguuuucucucccccaauuggccgucggggagaugucaaauucaagguggcccgcccguaucacuggcauggucgucgauccacgacucccccagguucuacacauccaaaacggccggugcacccuagaugggacacucauggguaccacccagcucaaccccaaugacaucugcaggauucgaggcuacuucuccagcucaaggcccgaguuacugugugaaggugaggagagugaggucaacacaacgcccacugauaguggagccacaggugaccagacaccagaagugagaaccggaacacgcgcgacccaaaggugguuugccgugacagaacucaauggccaggucuaugaccccuucggugaccaaccugcgccgcucgggguuccugacuucaaggcacgcauucuuggagcgcugaugcggcuaccugggaccaauccaacguccaacucaagguuugaggaugcguggguggagaccaacaaccagaccacuuaugcaccugcgaccgggguggucgccaucacaaccaaugacaacagcuccggcaauuaugcuaaugaccagacaugugaguuugucccgcuggguauugaaaucacggacucugcccccuacaacgaguucgaucugcccagcuacgguggugcagccuccucaggcaaccguaaucuggcccccacgguugccccaacguuuccaggagaggccauccuccuguuuggcucaaacaugccagucuauaacaggagcucaggcaccgacaacaaggacauacguugccucuugccuaaugaauauguacaacaccuguaugacacccaggcucccagucugagcgacguugcccuggucagguaugucaaccgugacacugggcgcgucuuguuugaggccaagcuacaccgcgacggcuucaugacagugaacgcguccuccaccacgguucuaccuguggacggguauuuccgcuuugauucuugggucaaccaguucuaugcacucagccccgugggaaacgccucaggcaggcgauaa

SEQ ID NO: 6771 - RNA, 1725 nt, Artificial Sequence
  VP1__Norovirus_and/or_Norovirus-like__JF939046
augaagauggcgucuaaugacgcugcauccccaucuucggauggggcagccaaccucguaccagagaucaacaaugagguuauggcuuuagaaccaguggccggcgcacaauuggcagccccugucgccggccaguucaaugcaauugaucccuggauaagacaaaauuuuguucaagcaccugaaggugaauucacaguuucuccucggaaugccccgggugagauucuguugaaucuggaauuggguccacaccucaaucccuuccugcaacauuuggcucagauguauaaugcauaugcaggcggcauggaagugcaggucguccuugcggggaaugcguucaccgccgggaagaucaucuuugccgcugucccuccacacuucccgccugagagacuuucugcggcgcaagccacccaguucccccaugugauaguugauguuaggcagcuugagcccauaauccugccccuccccgaugucagacauaauuuguuccauuucaaucagcaaaaugaugagaggaugcaucugguugccuuucuguacacaccccuacgugccaacucugggaguggugaugauguguuuacagugucaugucgggucuugacccgaccgucucaggacuuugaguucauguuccugguuccccccacggucgagaagaaaacaguggcguucucgcucccucaauuggcuaucggggaaaugucaaauucuagguggccugcccgcaucacaggcuuggucgucgacccucgacucccccaaguccugcacauccagaaugggcggugcacuuuagaugggacacucaugggcaccacacagcucaaccccaaugacauuugcaggauucggggcuacuucuccagcucaaggcccgaacugcuaugugagaaugaagaaagugcaacugauccaaugcccaccgagacugauacagacaaccagccaccagaggugagagcccaagcgcgugcgacucagcgaugguuugccgugacggagcucaauggacaaguuuaugacccuuucggugaucaacccgcaccgcuugggguuccugacuucaaggcacgcauacuuggugcauugaugcgacugccugggacuaauccaacauccaauucaagguuugaggaugcauggguggagaccaacaaucagaccaccuacgcacccgcggccgguguggucgccaucaccaccaaugauaauagcuccuccaacuaugccaaugaccagacaugcgaguuugugccacuaggcauugagaucacggacucagcccccuaccaugaguucgaucuacccaguuaugguggugcagccuccucagguaaccgcaaucuggcccccacgguugcccccacauucccaggugaggccauccuucuuuuuggcucaaauaugccagucuacaacaggaauacaggcaccagcaacaaggacauacggugucucuugcccaaugaguaugugcaacaccucuaugacacacaagcuccuagucuaagcgauguugcccucgucagguacgucaaccgcgacacuggacgcguccuguuugaggccaagcugcaccgcgacgguuucaugacagugaaugcgucuucuacaacgguccuaccuguagacggguauuuccgcuuugacucuugggucaaccaguucuaugcacucagccccgugggaaacgccucuggcaggcgauaa

SEQ ID NO: 6772 - RNA, 1722 nt, Artificial Sequence
  VP1__Norovirus_and/or_Norovirus-like__JF930689
augaagauggcgucuaaugacgccacggcuccaucucaggauggggcggccaaccucgucccagagagucagcaugagguuuuggccuuggaaccaguugccggggcagcacuugccgcccccguggcuggacaauuuaaugccauugaccccuggauuaagcaaaauuuuguccaagccccagccggggaguuuacggugucaccacguaaugccccuggagaaauccuuauggaucucgagcuuggcccugaauugaaccccuuucuggcacaccuugcacagauguacaacgccuaugcuggagggauggaagugcagauaauccuugcggggaacgcguucacugcagguaagauaauagucugugcuguaccaccaaauuuuccaccagaucggcugucugccucccaggccacaaacuucccacaugucaucauggacgucaggacguuagagccagugauccuccccuugccugacguucgcgcuggcuucuuccacuauaaccagcugagagagccgcgcaugcgacucauggcccuccuuuacacaccucugagagccaaugggacuggagacgaugccuucaccguuucgugcagggugcucacgcgcccuaugcaggauuuugaguucauguuccucgucccaccaaccgucgagucucgugucaccccuuuuucagugccaaccuaccccgugguggagaugacaaacuccagauggccagccaggauuucaggcaugcaugucaacgcaaaccaaacccuggcuguccaauuucagaauggcaggugcacccuggauggccaacucauggggaccacgcagcucugugccgccgaugucugcaggaugaggggucgauacacuuccaccagagccgaccuugcaggaguugaccacaccgaccaggguccgucccugggaacuggaccuucagaugauuccgucaguguuccggaggcgcgggcucagaccaggacuggugucagugcacaccuacagcuugaggagcugaauggccaacccuaugaagucuauggagagcaaccagcaccacuugggaccccagacuuucgcuguaggcugaugggagagcuugucagauugccauccaccagcccggcagcccagucgagauuccgugacgccuucuuugacaccuauggcgcgcucuucgccccagcggugggcuccacgaccuuuacggucaacaacagcuccaccucagacuuugccaauggccaacccuucgaguucuugccaauuggaguugagaucggaaacucugcucaguaugaugaguuugcgcugcccagcuacaacggggccauaggggagaaucgccaccucgccccugucgcggccccgggguuucccggugaaaacauagucuuuuucuccuccaaucuuccagugugggauuccaccuccgcgcagaacaacaggaggaucucaugccuguugcccaaugaguuuguccagcacuucuaugaccuccaggcaccgucccaauccgacguggcccuucugagguauguccacccugagucuggucgaguucuauuugagugcaagcuguacagagaugguuuucuuacugucaauggggcaagccucgcagaauucccagucaacggguacuucagguuugacucaugggugaaccaauucuucacacucagcccugugggaacuggcuccggccguagguaa

SEQ ID NO: 6773 - RNA, 1719 nt, Artificial Sequence
  VP1__Norovirus_and/or_Norovirus-like__GQ443611
augaagauggcgucuaaugacgccacggcuccaucucaggauggggcggccaaccucguuccagagagucagcaugagguuuuggccuuggagccaguugccggggcagcacuugccgcccccguggcuggacaauuuaaugccauugaccccuggauuaagcaaaauuuuguccaagccccagccggggaguuuacggugucaccacguaaugccccuggagagauccuuauggaucucgagcuuggcccugaauugagccccuuucuggcacaccuugcacagauguacaacgccuaugcuggagggauggaagugcagauaauccuugcggggaaugcguucacugcagguaagauaauagucugugcuguaccaccaaauuuuccaccagaucggcugucugccucccaggccacaaacuucccacauguuaucauggaugucaggacguuagagccagugauccuccccuugccugacguucgcgcuggcuucuuccacuauaaccagcugagagagccgcgcaugcgacucauggcccuccuuuacacaccucugagagccaaugggacuggagacgaugccuucaccgucucguguagggugcucacgcgcccuaugcaggauuuugaguucauguuccucgucccaccaaccgucgagucucgugucaccccuuuuucagugccaaccuacccugugguggagaugacaaacuccagauggccagccaggauuucaggcaugcaugucaacgcaaaccaaacccuggcuguccaauuucagaauggcaggugcacccuggauggccagcucauggggaccacgcagcucugugccgccgaugucugcaggaugaggggucgauauacuuccaccagagccgaccuugcagggguugaccacaccgaccaggguccgucccugggagcuggaccuucaaaugaucccgucaguguuccggaggcgcggucucagaccaggacuagugucagcgcacaccuacaacuugaagagcugaauggccaaccuuaugaagucuauggagagcaaccagcaccacucgggaccccagacuuuugcuguaggcugaugggagagcuugucagacugccauccaccagcccggcagcccagucgagguuccgugacgccuucuuugacaccuauggcgcgcucuuugccccagcggugggcuccacgaccuucacggucaacaacagcuccaccucagacuuugccaauggccaacccuucgaguucuugccaauuggaguugagaucggaaacucugcucaguaugaugaguuugcacugcccagcuacaacggggccauaggggagaaucgccaccucgccccugucgcggccccgggguuuccuggugaaaacauagucuuuuucuccuccaaucuuccagugugggauuccaccuccgcgcagaacaacaggaggaucucaugccuguugcccaaugaguuuguccagcacuucuaugaccuccaggcaccgucccaguccgacguggcccuucugagguauguccacccugagucuggucgaguucuauucgagugcaagcuguacagagaugguuuucucacugucaauggggcaagccucgcagaauucccagucaacggguacuucagauuugacucaugggugaaccaauucuucacacucagcccugugggaacuggcuccggccguuaa

SEQ ID NO: 6774 - RNA, 1719 nt, Artificial Sequence
  VP1__Norovirus_and/or_Norovirus-like__EU224456
augaagauggcgucuaacgacgcugcuccaucgucagauggugcuggcaaccucguuccagagagucaccaagagguauugccacuugcccccguagcaggcgcggcuauagcugcaccaguuguggggcaacagaacauaauugaccccuggauuaaagaaaauuuugugcaggccccccagggugaguucaccgugucaccuaagaacucuccuggugaaguccuuguuaauuuggaguugaguccaaaauugaaucccuauuuggaucaucuuucuaaaauguauaaugccuaugcugguggcauggagauugaaauaauccuugcagggaaugcguucacugcaggcaaggugcucauagcggcagucccccccaacuucccaguugagaauaucucggucucccaggccagucaauucccccaugugauuguggaugucaggacccuugagccaauccgccuaccccugcccgaugugcgcaccaauuucuuccauuauaccaccagagaugaaccaaagaugcgcauaguugcguggcucuauaccccauugaggacaaauggcaguggagaugacuccuucacaguuucagggcgcauauuaacccgcccaucugcugauuuugaguucuccuuucuuguaccaccaacuguugagaccaaaaccgucuccuucucaguccccggccuaacggucgaggagauguccaacuccagguggcccgcccagaucaaugggcugguggucagaggcaaugaggcucaaguuguucacuuccaaaacggcagguguaccacugaaggcaugcuccuuggcacaacaacucucaaugucaauuccaucuguggccuacggggcacaucaauuucacaugccuccgugcgcgaagccccugcacucagugaggagaugccgccacuugaagaugaaguggcccacggcgcugcugccaccuaugccguuggucgugcugcugacaccacccuauggaucaggguagaggaacccaauggacagcccuaugacaucuuuggggaacaaccagcgccacuggggacucccgauuucacggcagugaucaucggcaccgccaucagaccacgcacugccaguggugcguaccuucaugaugccuauguggauaccagaccaggugaugcagauuucacccccucaacuggcaacaccaagaucguguugcgugggggugguaguggccaugucggcgagggccacuauuggcaauucaagcccaucgccguugaggguggcccaaacaggccuguuuaccaggaauacaaccugccugaguaugccgggcccaccgcauccaaucacaaucuggcgccaccagucgcccccaagaugcccggugagcuccuguugcucuuugagucggacaugccggucugggacaaugggaguggcuccgcccccacacaaaagauucauugucugcuccccaaugauuuugucacccacuucuuugauuuacaagccccagcccuugcugaagccgcccuccuaagguauguccacccugauaguggcagaacucucuucgagugcaagcucuacagggagggcuacaugguugugguugcccccucaggcagacuggauuucccacuggauggguauuucagguuugauuccugggucaaugcuuucuauguccuuucccccgugggaaacggccaaggccgucgguaa

SEQ ID NO: 6775 - RNA, 1719 nt, Artificial Sequence
  VP1__Norovirus_and/or_Norovirus-like__EF450827
augaagauggcgucuagugacgccaccccaucgucugauggugcuggcaaccucgucccagagagucaacaagaggucuugccacuugcucccguggcgggcgcggccuuagccgcaccaguugugggacaacagaacauaauugaccccuggauuaaagaaaauuuugugcaggcuccccagggugaauucaccguuucacccaagaauuccccuggcgagguccuggucaacuuggagcugagcccuagguugaacccuuauuuacaccaccuuucaaagauguauaaugccuaugcuggcggcauggaggucgagauaauccucgcugggaacgcuuucacugccggcaaaguacucauugcagcggugccaccaaauuuccccaucgagaacgucucggccucucaggcuagccaguucccccaugugauuguggauguuagaacucuugagcccauucgccuaccccugccugacgugcgcaccaacuucuuccacuacaccacacaggaggagcccaggaugcgcaucgucgcuuggcucuacaccccguugaggacgaacggcagcggcgaugauucauuuacagucucugggcguauuuugacacgcccauccccagauuuugaguuuucuuucuugguuccgccaacugucgagacuaagaccgucucauucucaguuccuggcuuggucguccaggauauguccaacuccagguggccugcccagaucagcggguuggucgucaggggcaaugaggcccagguugugcacuuucaaaauggcaggugcaccaccgaaggcaugcuccuuggcacaaccacgcucaacauuaauuccaucuguggucugcggggacuuucagucucucaagccuccgugcgcggcgcccccgcgcucaccgaggagaugccgccucucgaggaugagguggcugauggugccgccgccaccuacacccucacccgcgccgcggacaccgcgcuguggcugaggguggaggaacccgauggccgccccuaugacaucuucggggaucagccggcaccccuagggacgcccgacuucacggcagugauugucggcaccgccaucaggccucgcaccacgucuggcgcguaccuccacgacgccuacguggacaccacccccggcgacgcugauuucaccccuuccacugggaacaccaagaucgugcugcgagguggugguucuggccacgucggucaaggccauuacuggcaguuuaagccgaucgcuguugagggugguggaaguagaccccaguaccaggaguacaaucugcccgauuacgccgggccgaccgcauccaaccaugaucuggcaccaccggucgcccccaggaugccuggugagcucuuguugcucuuugaaucugacaugccugugugggacaacggggccggcgcggcacccgcgcagaaaauucauugucuucuccccaaugaguucauaacccaccuguuugaucuccaagccccggcucucgccgaggcggcccuccugagguauguccacccugauagcgguagaacccucuuugaaugcaagcuuuacagagaaggcuacauggucguggccgcaccaguugguagacugaacuucccacucgauggguacuucagguuugauucuugggucagcgcauucuacguccucucccccgugggaagcggucaaggccgucgguaa

SEQ ID NO: 6776 - RNA, 1719 nt, Artificial Sequence
  VP1__Norovirus_and/or_Norovirus-like__JF781268
augaagauggcgucuagcgacgccaccccaucgucugauggugcuggcaaccucguuccagagagucaacaagaggucuugccacuugcuccuguggcgggcgcggccuuagccgcaccagucguggggcaacagaacauaauugaccccuggaucaaagaaaauuuugugcaggcuccccagggugaguucaccguuucaccuaagaacuccccuggcgagguccuagucaauuuggagcugagcccuagauugaacccuuauuuggaucaccuuucaaagauguauaaugccuaugcugguggcauggagguugagauaauccucgcggggaacgcuuucacugcuggcaaagugcucauugcagcggugccaccaaacuuccccaucgagaacaucucggccucucaggcuagccaguucccccaugugauuguggaugucagaacucucgaacccauucgccuacccuugcccgaugugcgcaccaacuucuuccacuacaccacacaggaggagcccagaaugcgcaucgucgcuuggcucuacaccccgcugaggacgaacggcagcggcgaugacuccuucacagucucugggcgcauuuugacacgcccauccccagauuuugaguuuuccuuccugguuccgccaacugucgagacuaagaccgucucguucucagucccuggcuuggucgucgaggauauguccaacuccagguggccugcccagaucaacggguuggucguuaggggcaaugaggcccagguugugcacuuucaaaauggcaggugcaccaccgaaggcacgcuccuuggcacgaccacgcucagcaucaacuccaucugcggacugcggggacucucagucucccaagccuccgugcgcggcgcccccgcgcucaccgaggagaugccgccucucgaggaugagguggcugacggugccgccgccaccuacacccucgcccgugccgcggacaccacgcuguggcugaggguggaggaacccgauggccgucccuaugacaucuucggggaccagccggcgccccuagggacacccgauuucacggcagugauugucggcaccgccaucaggccccguaccgcgucuggcgcguaccuccacgacgccuacguggacaccacuccuggugacgcugacuucacucccuccacuggcaacaccaagaucgugcugcgagguggugguucuggccacgucggccaaggccacuacuggcaguuuaggccgaucgcugucgagggugguggaaguagaccccaguaccaggaguauaaucugcccgauuacgccgggccgaccgcguccaaccaugaucuggcaccaccggucgccccuagaaugcccggugagcuccuguuacucuuugaaucugacaugccugugugggacaacggggcuggcgcggcacccgcgcagaaaauucauugccuucuccccaaugaguuuauaacccaccuguucgaucuucaagccccggcucucgccgaggcggcccucuugagguauguccacccugacagcggcagaacccucuuugaauguaagcucuacagggagggcuacauggucguggccgcaccagcugguaggcugaauuucccgcucgauggguacuucagguuugauucuuggguuagugcauucuacauccuuucccccgugggaagcggccaaggccgucgguaa

SEQ ID NO: 6777 - RNA, 1698 nt, Artificial Sequence
  VP1__Norovirus_and/or_Norovirus-like__KT245136
augaagauggcgucuaacggcgcugcggcuccaucucaggauggugcggccaaccucgucccagagagucaacaagagguuuuggccuuggaaccggucgccggagcagcccucgccgcuccuguggcuggacaguuuaaugccauugaccccuggauuaagcaaaauuuuguccaagccccagcuggggaguuuacagucucgccacgcaacgccccuggggaaguccuuauggaucucgagcuuggcccugaaaugaaccccuuccuagcacaccuagcccaaauguacaacgccuaugcuggagggauggaagugcagauuauucuugccgggaaugcguucaccgcggguaagauaauaguuugcgccgugccaccaaacuucccgccggaccggcugucagccucacaggccacaaacuucccacauguuaucauggacgucagaacauuggaaccagugguccucccccuuccugacguccgcgcugguuucuuccacuacaaccagcugagagaaccgcguaugcgacucaugacccuucuuuacacgccacuaagggccaauggaacuggggaugaugccuucaccgucucguguaggguucucacacgcccuaugcuggauuuugaguuuauguuucuugucccgcccacaguugaaucccgcgucacccccuuuucagucccaacuuauccuguaguggaaaugacaaacuccagauggccagccaggaucucaggcaugcaugucaacgcaaaccaaacccuggcuguucaauuccagaauggcaggugcacccuggauggccaacucauggguacuacacaacucugcgccgccgacguuugcaggaugagggggcgguacaccuccaccagggccgacccugccgggcugggcugggaccuggaugccaccacccuugucgacggcccggaggcgcgaguccaagccaggauaagugugucugcacaucuccaacuugaggaacugaguggccagccuuaugagguuuacggggagcaaccagcaccacuuggaaccccagacuuccaauguaggcugaugggggaacucguuaggcugccguccgccaacccgguggcccaaucgagguuccgugaugccuucuuugacaccuacggcgcccuuuucgcucccgcagucggcuccgugaccgucacagucaacaauagcuccagcucagacuucgccaacgaccagcccuuugaguucuugccaauuggcguugagauaggcaacuccgccagguacgacgaguuugcacugcccaguuacaacggggccauaggggaaaaccgccaucuugccccuaucgcagccccgggguucccuggugagaacuuaauuuucuuuuccuccaaccugccagugugggacuccaccucugcacaaagcaacagaagaaucucaugucuguugcccaaugaauucauacagcacuucuaugaucuccaggccccgucccaaucugauguggcccuccugagauacguccaucccgagacugaucgguuucuguuugagugcaagcuguacagagaugcuuuucuuacugucaauggagcgaguuacgcagaauucccagucaacggguauucuagauuugacucuugggugaaacaauucuucacacucagcccugugggaacuggcucuggccguagguaa

SEQ ID NO: 6778 - RNA, 1659 nt, Artificial Sequence
  VP1__Norovirus_and/or_Norovirus-like__AJ844470
augaagauggcgucuaaggacgcaucgccaucuacggauggugcagccaaccucguuccagagagucaacaggagguuuuggcuuugcaaccaguugcuggcgcacaaauagccgcgccuguagcugggcaauucaauguaauugaccccuggauauaucaaaacuuuguacaggcgccugagggagaguucaccgugucaccccguaacuccacaggugaaauccuaaugaauuuggaauuaggcccacaguuaaauccuuauuuggcccaucuggcacgcauguacaaugcuuacgcuggcgguuucgaagugcaagugcugcuggccggcaacgccuucaccgcggguaagauaauugugugugccgugcccccaaacuucccucugcaaaauauaucagcugcacaggccacacaacuuccccauguugugguugaugugagacaauuggaacccgugguccuaccccucccagacgugcgugcaggcuucuaccauuacaaucagguugaagaaucccguaugcguuugguggccauuuuguacacuccacuaaggacuaauucugcgggugacgaugcauuuacagucuccugccgcauucucaccagaccagcaccugauuuuagcuucuuuuuccuaauaccccccacaauagagucuaaaacaacacccuucacuuugcccagguugccaauaucugagaugacaaacucuagguucccucuugugauaaaggguaugguuguggaucccaaccuuccauugcaagccaacuuccaaaaugguaggaucacgcuggauggggagcuccaggguacaacacuacccacuucaacuagcauuggcaggauuucuggcaccuacauguccagcaccccaaguagaaucauacagcaugaggauuccggugauuccacccaacccagagucuucaauccaguguggauggauuuaacugagaacaacuggacugaauuccagccauucaaugaccaacccgccccacuuggguguccagacuucaaagccaaaauuuugggcacauugauucgccaaccuaauaaugguuccuauuauuuugaugcauaucuagacacuagacaacauggcacuuuugcaccguacaccgggcaugccgcuguccauucugaucaacaggcaggccauuuggcccaaggcuacaaaauucaauucuccccaacaggcauugagagugaccaaaacacugacuugaaucagcuucccgacuauggaggggccaugacugucagcaaggggcuggcuccagcagccgcgcccgacuuccccggugagaugauucuuuacuuugucucugacaugccaguccgcaacccaaauggggaaaggagggacacugagaucuugugucugcugccgcaggagauggucacccacuucuacgaacagcaagcccccucccagggugaugucgcgcuugugcgcuacaucaaugccgagacugguagagucauguucgagggaaagcugcacaggaauggauucuucacaguuucugccacugcaagaacuuuaauuguaccugauggcuauuucagauuugacucuuggguuaauagguuuuacacauuaagccccaugggaacaggcaauggccgcagaagggcucgcuaa

SEQ ID NO: 6779 - RNA, 1659 nt, Artificial Sequence
  VP1__Norovirus_and/or_Norovirus-like__KJ196291
augaagauggcgucuaaggacgcaucgccaucuacggaugguacagccaaccucguuccagagagucaacaggagguuuuggcuuugcaaccaguugcuggcgcacaaauagcugcaccuguagcugggcaauucaauguaauugaccccuggauauaucaaaauuuugugcaggcgccugagggagaguucaccgugucaccccguaacuccacaggugaaauccuaaugaauuuggaauuagguccacaguugaauccuuauuuggcccacuuggcacgcauguacaaugcuuaugcuggcgguuuugaagugcaagugcugcuggccggcaaugcuuucaccgcggguaagauaauugugugugccgugccuccaaacuucccucugcaaaauauaucagcugcacaggccacacaacuuccccauguugugguugaugugagacaauuggaacccgugguccuaccucucccagacgugcgugcgggcuucuaccauuacaaucagguugaagagucccguaugcguuugguggccauuuuguacacuccauugaggacuaauucugcaggugacgaugcauuuacagucuccugccgcauccucaccagaccagcaccugauuuuagcuucuuuuucuuaauaccccccacaauagaaucuaaaacaacaccuuucacucugcccagguugccaauaucugagaugacaaacucuagauucccucuugugauaaaggguauggucguggauccuaaucuuccauugcaagcuaacuuccaaaaugguaggaucacacuggauggggagcuccaggguacaacacuacccacuucaaccagcauuggcaggaucucuggcacccacauguccagcaccccaaguaggauuauacagcaugaggacuccggugauuccacccagcccagagucuucaauccaguguggauggauuuaacugagaacaacuggacugaauuccagccauucaaugaccaacccgccccacuugggugcccagacuucaaagccaaaauauugggcacauugauucgccagccuaauaaugguuccuauuauuuugaugcauaucuagauaccagacaacauggcacuuuugcaccauacaccgggcacgccgcuguccacucugaccaacaggcaggccauuuagcccaaggcuacaaaauucaauucuccccaacaggcauugagagugaccaaaacacugacuugaaccagcuucccgacuauggaggggccaugacugucagcaaggggcuggcuccagcggccgcgcccgauuuccccggugagaugauccuuuacuuugucucugacaugccaguccguaacccaaauggggaaaggagggacacugagaucuuguguuugcugccgcaggagauggucacccacuucuacgaacagcaagcccccucccagggugaugucgcgcuugugcguuacaucaaugccgagacugguagagucauguucgagggaaagcugcauagaaauggauucuucacaguuucugccacugcaagaacuuuaauuguaccugauggauauuucagauuugacucuuggguuaauagguuuuacacauuaagccccaugggaacaggcaauggccgcagaagggcucgcuaa

SEQ ID NO: 6780 - RNA, 1653 nt, Artificial Sequence
  VP1__Norovirus_and/or_Norovirus-like__KU870455
augaagauggcgucgaaugacgccgcuccaucaaaugauggugcugccaaccucguaccagaggccaauaaugagguuauggcacuugaaccgguggugggagcuucaaucgcagcuccuguugucggucagcagaauauaauugaccccuggauuagagaaaauuuuguucaagcaccacagggcgaguuuacuguuucaccaaggaacucgcccggugagaugcuucuaaaucuugaauugggcccagaacuuaaccccuauuugagucauuugucccgcauguacaauggguaugcugguggcaugcagguucaggugguccuagcugggaaugcguucacagcugggaagaucaucuuugccgcugugccaccacacuucccuguggauaauauuagugcagcccagauaacuauguguccccaugugauuguugaugugagacagcuugaaccagugcuucuaccccuccccgauauaaggaacagguucuuccauuacaaccaggaagacaccccccggaugaggcuuguggccaugcucuacacgccucuaagggcuaauuccggagaggauguguucacuguguccuguaggguucugacucgccccgcuccagauuuugaauuuacauucuuaguuccaccaacuguugaaucaaaaacaaaacccuuuacucuaccuauucuaacccuuggugagcugucuaauucccguuuuccugcugccauagauaugcuuuacacugaucccaaugaaucaauaguuguucagccccaaaaugguagauguacccuugacggcacgcugcaaggcacaacacaauuggucccaacacagauuugugccuuuagagguacucugaucagucagaaugcgagagcggccgauuuaacagauuccccccagagagcccgugaucacccguugcacguccaggucaagaaccuagauggcacacaguaugacccaacagaugacaucccugcaguccugggggcuauugacuucaaagguacaguguucggaguggcaagucagagggacgucucuggaacacaagaacagggccauuaugccacccgggcucaugaagcacacauugacacaacugauccaaaguaugcaccuaaauuaggcacaauucucauuaaaucugaaucuacugauuucaccacaaaucagcccauuagguucacuccagugggcaugggcgacaacaauuggagacagugggaauugccugacuauucugguaguuugacucuaaauaugaaccuugccccugcuguuuccccaucuuucccuggugaacgaauccuuuucuuuaggucuauaguaccaucagcuggaggcuacgggucuggcuauauagacugucucauaccccaggaaugggugcaacauuucuaccaggaggcagcaccuucgcaauccgcuguugcacugguuagguaugucaaccccgacacugggcguaacaucuuugaggccaaguugcacagagaaggguuccucaccguggccaauucuggaaacaauccuauugugguucccccuaaugguuauuuuagauuugaggcuuggguuaaucaauucuauacacuugcccccaugggaucuggacaggggcguagaagagcucaguaa

SEQ ID NO: 6781 - RNA, 1653 nt, Artificial Sequence
  VP1__Norovirus_and/or_Norovirus-like__AF414408
augaagauggcgucgaaugacgcugcuccaucgaaugauggugcugccaaccucguaccagaggccaacaaugagguuauggcacuugaaccgguagugggagccucaaucgcagcuccuguugucggucagcaaaauauaauugaccccuggauuagagaaaauuuuguccaagcaccacagggcgaguucacuguuucaccaaggaauucgccuggugagaugcucuuaaaucuugaguugggcccggaacuuaaucccuauuugagucauuuaucacgcauguauaacggauaugcugguggcaugcagguucaggugguccuagcugggaaugcguucacagcugggaaaaucaucuuugccgccguaccaccacauuucccuguagaaaacaucagugcagcccagauaacuauguguccccauguaauuguugaugugaaacagcuugagccagugcuuuugccccucccugacauaaggaauagauucuuccacuacaaccaggaggacacuccccgaaugaggcuuguagccaugcucuauacaccucuaagggccaauucuggcgaggauguguucacuguguccuguaggguucugacucgcccugcuccagauuuugaguuuacauucuuagugccaccaacuguugaaucaaaaacaaagcccuuuacuuugccuauccugacccuuggugaguugucuaacucucgcuuuccggcugcuauagauaugcuuuauacugauccuaaugaaucaauaguuguacaaccccaaaaugguaggugcacucuugauggcaccuugcaaggcacaacacaauuaguucccacacagauuugugcuuuuaggggcacccugaucagccagaccgcgagagcggccgacucaacaggcuccccccagagagcccgcaaucauccauuacacguccaggucaagaaccuagacggcacacaguacgacccaacggaugauauaccugcaguccugggggcuauugacuucaaaggcacagucuuuggaguggcuagccagagggaugucucuggacaacaagaacagggccauuaugccaccagagcccaugaagcacacauugauacaacugacccaaaguaugcacccaaauugggcacaauucuuaucaaaucugauucugaugauuuuaauacaaaucagcccauuagguucacuccggugggcaugggugauaauaauuggagacagugggaauuacccgacuauucuggccauuuaaccuugaauaugaaccuugccccugcuguuucuccauccuucccuggugaacgaauccuuuucuucaggucuauagugccaucagccggcggcuaugggucuggcuauauagacugucucauaccccaggaaugggugcagcauuucuaccaggaagcagcgccuucacaaucugccguugcacugguuagguaugucaaccccgacacugggcguaacaucuuugaggccaaguugcacagagaaggcuuccucaccguggccaauucuggaaacaacccaauuguggucccccccaauggcuauuuuagauuugaggcuuggguuaaucaguuuuacacacuugcccccaugggaucaggacaggggcguagaagggcccaguaa

SEQ ID NO: 6782 - RNA, 1653 nt, Artificial Sequence
  VP1__Norovirus_and/or_Norovirus-like__AB084071
augaagauggcgucgaaugacgccgcuccaucgaaugauggugcugccaaccucguaccagaggccaacaaugagguuauggcacuugaaccggugguaggagccucaaucgcagcuccuguugucggucagcaaaauauaauugaccccuggauuagagaaaauuuuguccaagcaccacagggcgaguuuacuguuucgccaaggaauucgccuggugagaugcuuuuaaaccuugaguugggcccagaacuuaaccccuauuugagucauuugucccgcauguacaacggauaugcugguggcaugcagguucaggugguccuagcugggaaugcguucacagcugggaaaaucaucuuugccgccguaccaccacauuuuccuguggauaauauuagugcagcccagauaacuauguguccccaugugauuguugaugugagacagcuugaaccagugcuucugccccuccccgauauaaggaauagguucuuccauuacaaucaggagaacaccccccggaugagacucguggccaugcucuacacgccccugagggccaauucuggugaagacguguucacugugucuuguaggguuuugacucgccccgcuccagauuuugaguuuacauucuuaguaccaccaacuguugaaucaaaaacaaaaccuuuuacccuaccuauucuaacucuuggcgaguugucuaacucccguuuuccggcugcuauagauaugcuuuauacugaucccaaugaaucaauaguuguucaaccccaaaaugguaggugcacucuugauggcacauugcaaggcacaacacaauugguuccaacacagauuugugcuuuuagaggcacccugaucagccagaccgcgagagcggccgacucaacagauucuccccagagagcccgugaucauccauuacacguccaggucaagaaccuagacggcacacaguaugacccaacagaugacauaccugcaguccugggggcuauugacuucaaaggcacaguauuuggaguggcuagucagagggaugucucuggaccacaagaacagggccacuaugccacccgagcucaugaaacacacauugauacaacugacccaaaguaugcacccaaauuaggcacaauucuuaucaaaucugaauccaaugauuucauuacaaaucaacccauuagguucacuccagugggcaugggugauaacaauuggagacagugggaauuaccugauuauucuggcagauuaaccuuaaauaugaaccuugcccccgcuguuuccccaucuuucccuggugaacgaauccuuuucuuuaggucuauaguaccaucagcuggaggcuacgggucuggcuauauagacugucucauaccccaggaaugggugcaacacuucuaccaggaagcagcaccuucacaauccgcugucgcacugguuagguauguuaaccccgauacugggcguaacaucuuugaggccaaguugcacagagaaggguuccucaccguggccaauucuggaaacaauccuauuguaguucccccuaaugguuauuuuagauuugaggcuuggguuaaucaguuuuacacacuugcccccaugggaucuggacaggggcguagaagggcccaguaa

SEQ ID NO: 6783 - RNA, 1653 nt, Artificial Sequence
  VP1__Norovirus_and/or_Norovirus-like__AF414407
augaagauggcgucgaaugacgcugcuccaucgaaugauggugcugccaaccucguaccagaggccaacaaugagguuauggcacuugaaccgguugugggagccucaaucgcagcuccugcugucggucagcaaaauauaauugaccccuggauuagagaaaauuucguccaagcaccacagggcgaguucacuguuucaccaaggaauucgccuggugagaugcucuuaaaucuugaguugggcccagaacuuaaucccuauuugagucauuugucccgcauguacaauggauaugcugguggcaugcagguucaggugguccuagcugggaaugcguucacagcugggaaaaucaucuuugccgccguaccaccacauuucccuguagaaaacaucagugcagcucagauaacuauguguccccaugugauuguugaugugaggcagcuugaaccagugcuuuugccccucccugauauaaggaauagguucuuccacuacaaccaggagaacaccccccgaaugagacucguagcuaugcucuacacaccucuaagggccaauucuggcgaggauguguucacuguguccuguaggguuuugacucgcccugcuccagauuuugaguuuacauuuuuaguaccaccaacuguugaaucaaaaacaaaacccuucacuuuaccuacucugacccuuggugaguugucuaacccucgcuuuccggcugcuauagauaugcuuuauacugauccuaaugaaucaauaguuguacaaccccaaaaugguaggugcacucuugauggcaccuugcaaggcacaacacaauuaguccccacacagauuugugcuuuuaggggcacccugaucagccagaccgcgagagcggccgacucaacagacuccccccagagagcccguaaucauccauuacacguccaggucaagaaccuagacggcacacaguacgacccaacggaugauauaccugcaguccugggggcuauugacuucaaaggcacagucuuuggaguggcuagucagagggacgucucuggacaacaagaacagggucacuaugccaccagagcccaugaagcacacauugacacaacugacccaaaguaugcaccuaaauugggcacaauucuuaucaaaucugauucugaugauuuuaacacaaaucagcccauuagguucaccccggugggcaugggugacaacaauuggaggcagugggaauuacccgacuauucuggcagacuaaccuugaauaugaaccuugccccugcuguuucuccauccuucccuggugaacgaauucuuuucuucaggucuauaguaccaucagccggcggcuacgggucugguuacauagacugucucauaccccaggaaugggugcagcacuucuaccaggaagcagcgccuucacaaucagccguugcacugguuagguaugucaaucccgauacugggcguaacaucuuugaggccaaguuacacagggaaggcuuccucaccguggccaauucuggaaacaacccaauuguggucccccccaaugguuauuuuagauuugaggcuuggguuaaucaguuuuauacacuugcccccaugggaucuggacaggggcguagaagggcccaauaa

SEQ ID NO: 6784 - RNA, 1653 nt, Artificial Sequence
  VP1__Norovirus_and/or_Norovirus-like__AB039777
augaagauggcgucgaaugacgccgcuccaucgaaugauggugcugccaaccucguaccagaggccaacaaugagguuauggcacuugaaccggugguaggagccucaaucgcagcuccuguugucggucagcaaaauauaauugaccccuggauuagagaaaauuuuguccaagcaccacagggcgaguuuacuguuucgccaaggaauucgccuggugagaugcuuuuaaaccuugaguugggcccagaacuuaaccccuauuugagucauuugucccccauguacaacggauaugcugguggcaugcagguucaggugguccuagcugggaaugcguucacagcugggaaaaucaucuuugccgccguaccaccacauuuuccuguggauaauauuagugcagcccagauaacuauguguccccaugugauuguugaugugagacagcuugaaccagugccucugccccuccccgauauaaggaauagguucuuccauuacaaucaggagaacaccccccggaugagacucguggccaugcucuacacgccccugagggccaauucuggugaagacguguucacugugucuuguaggguuuugacucgccccgcuccagauuuugaguuuacauucuuaguaccaccaacuguugaaucaaaaacaaaaccuuuuacccuaccuauucuaacucuuggugaguugucuaacucccguuuuccggcugcuauagauaugcuuuauacugaucccaaugaaucaauaguuguucaaccccaaaaugguaggugcacucuugauggcacauugcaaggcacaacacaauugguuccaacacagauuugugcuuuuagaggcacccugaucagccagaccgcgagagcggccgacucaacagauucuccccagagagcccgugaucauccauuacacguccaggucaagaaccuaggcggcacacaguaugacccaacagaugacauaccugcaguccugggggcuauugacuucaaaggcacaguauuuggaguggcuagucagagggaugucucuggaccacaagaacagggccacuaugccacccgagcccaugaagcacacauugauacaacugacccaaaguaugcacccaaauuaggcacaauucuuaucaaaucugaauccaaugauuucaccacaaaucaacccauuagguucacuccagugggcaugggugauaacaauuggaggcagugggaauuaccugauuauucuggcagauuaaccuuaaauaugaaccuugcccccgcuguuuccccaucuuucccuggugaacgaauccuuuucuuuaggucuauaguaccaucagcuggaggcuacgggucuggcuauauagacugucucauaccccaggaaugggugcaacacuucuaccaggaagcagcaccuucacaauccgcugucgcacugguuagguauguuaaccccgauacugggcguaacaucuuugaggccaaguugcacagagaaggguuccucaccguggccaauucuggaaacaauccuauuguaguucccccuaaugguuauuuuagauuugaggcuuggguuaaucaguuuuacacacuugcccccaugggaucuggacaggggcguagaagggcccaguaa

SEQ ID NO: 6785 - RNA, 1653 nt, Artificial Sequence
  VP1__Norovirus_and/or_Norovirus-like__AB078337
augaagauggcgucgaaugacgcugcuccaucgaaugauggugcugccaaccucguaccagaggccaacgaugagguuauggcacuugaaccgguggugggagccucaauugcagcuccuguugucggccagcaaaauauaauugaccccuggauuagagaaaauuuuguccaagcaccacaaggugaguucacuguuucaccaaggaauucgccuggcgagaugcucuuaaaccuugaguugggcccagaacuuaaucccuauuuaagucauuugucccgcauguacaacggauaugcugguggcaugcagguucaggugguccuagcugggaaugcguucacagcugggaaaaucaucuuugccgccgugccaccacauuucccuguagaaaacaucagugcagcccaaauaacuauguguccccaugugauuguugaugugagacaacuugaaccagugcuucugccccucccugauauaaggaauagguucuuccacuacaaccaggagaacaccccccggaugaggcuuguagccaugcucuauacaccucuaagggcuaacucuggugaggauguauucacuguguccugcaggguucugacucgccccgccccagauuuugaguucacauuuuuaguuccaccaacuguugaaucaaaaacaaaacccuuuacuuuaccuaucuugacucuuggcgaguugucuaauucucgcuuuccggcugcuauagauaugcuuuauacugacccuaaugaaucaauaguuguacaaccccaaaaugguaggugcacccuugaugguacauugcaaggcacaacacaauugguucccacacagaucugugcuuuuagaggcacccugaucagccagaccgcgagagcggccgauucaacagauuccccccagagagcccguaaucauccacugcacguccaaguuaagaaccuagacgguacacaauaugacccaacggacgauauaccugcaguccugggggcuauugacuucaaagguacagucuuuggaguggcuagucagagggauguuucuggacaacaagaacagggccacuaugccacccgagcccaugaagcacacaucgacacaacugauccaaaguaugcacccaaauuaggcacaauucucauuaaaucugguucugaugauuucaauacaaaccagcccauuagauucacuccggugggcaugggugacaacaauuggagacaaugggaauugcccgacuauucuggcagauuaaccuuaaauaugaaccuugcuccugcuguuucuccaucuuucccuggugaacgaauccuuuucuucagguccauaguaccaucagccggaggcuacgggucuggcuacauagacugucucauaccccaggaaugggugcagcacuuuuaccaggaagcagcaccuucacaaucugcuguugcacugguuagguaugucaaccccgauacugggcguaacaucuuugaggccaaacugcacagagaaggguuccucaccguggccaacuguggaaacaauccuauuguagucccccccaauggcuauuucagauuugaggcuugggguaaucaguuuuauacacuugcccccaugggaucuggacaggggcguagaagggcccaguaa

SEQ ID NO: 6786 - RNA, 1653 nt, Artificial Sequence
  VP1__Norovirus_and/or_Norovirus-like__AB039776
augaagauggcgucgaaugacgccgcuccaucgaaugauggugcugccaaccucguaccagaggccaacaaugagguuauggcacuugaaccggugguaggagccucaaucgcagcuccuguugucggucagcaaaauauaauugaccccuggauuagagaaaauuuuguccaagcaccacagggcgaguuuacuguuucgccaaggaauucgccuggugagaugcuuuuaaaccuugaguugggcccagaacuuaaccccuauuugagucauuugucccccauguacaacggauaugcugguggcaugcagguucaggugguccuagcugggaaugcguucacagcugggaaaaucaucuuugccgccguaccaccacauuuuccuguggauaauauuagugcagcccagauaacuauguguccccaugugauuguugaugugagacagcuugaaccagugccucugccccuccccgauauaaggaauagguucuuccauuacaaucaggagaacaccccccggaugagacucguggccaugcucuacacgccccugagggccaauucuggugaagacguguucacugugucuuguaggguuuugacucgccccgcuccagauuuugaguuuacauucuuaguaccaccaacuguugaaucaaaaacaaaaccuuuuacccuaccuauucuaacucuuggugaguugucuaacucccguuuuccggcugcuauagauaugcuuuauacugaucccaaugaaucaauaguuguucaaccccaaaaugguaggugcacucuugauggcacauugcaaggcacaacacaauugguuccaacacagauuugugcuuuuagaggcacccugaucagccagaccgcgagagcggccgacucaacagauucuccccagagagcccgugaucauccauuacacguccaggucaagaaccuagacggcacacaguaugacccaacagaugacauaccugcaguccugggggcuauugacuucaaaggcacaguauuuggaguggcuagucagagggaugucucuggaccacaagaacagggccacuaugccacccgagcccaugaagcacacauugauacaacugacccaaaguaugcacccaaauuaggcacaauucuuaucaaaucugaauccaaugauuucaccacaaaucaacccauuagguucacuccagugggcaugggugauaacaauuggagacagugggaauuaccugauuauucuggcagauuagccuuaaauaugaaccuugcccccgcuguuuccccaucuuucccuggugaacgaauccuuuucuuuaggucuauaguaccaucagcuggaggcuacgggucuggcuauauagacuaucucauaccccaggaaugggugcaacacuucuaccaggaagcagcaccuucacaauccgcugucgcacugguuagguauguuaaccccgauacugggcguaacaucuuugaggccaaguugcacagagaaggguuccucaccguggccaauucuggaaacaauccuauuguaguucccccuaaugguuauuuuagauuugaggcuuggguuaaucaguuuuacacacuugcccccaugggaucuggacaggggcguagaagggcccaguaa

SEQ ID NO: 6787 - RNA, 1653 nt, Artificial Sequence
  VP1__Norovirus_and/or_Norovirus-like__KT030674
augaagauggcgucgagugacgcugcuccaucuacggauggugcgggcaaccucguuccagagagucaacaagagguguugccccucgccccaguugcaggcgcugcguuagcggcaccugugguggggcaaacaaauauaauugaccccuggauuaaagaaaauuuuguucaagccccccagggugaguuuacugucucaccuaaaaauucuccuggugaaauuuuaguuaauuuggaauugggacccaaacucaaccccuaucuagaccaccuuucacgcauguauaauucauaugcugguggcauagaugucauggugguguuggcgggcaacgccuucacagccggcaagguuuuaauagcagcuauccccccaaauuucccaguggaaggaguguccgcuucacaggccacucaauucccccaugugauuauagauguuaggacacuugacccugugcggcucccccucccggaugugcgauccacguucuuccauuacacuaaugauacugaaccaaagaugagguuaguuauuuggcuuuacaccccacuuagaacuaauggcaguggugaugauucuuucaccgucucugggcgcauacucacaaggcccucccaggacuuugaguuugcuuuccuuauccccccaacaguggagacaaagacaacccccuuuucagugccaggcuucucggugcaggaaauguccaacucaagguggccagcugccaucucugcaauggucguccgugggaaugagccccaagucguucaguuccagaauggcagggcccaucuggaugguaugcugcuugguacgacaccugugucgcccaauuacauagcauccuaccgaggcauuuccacuggcaacucucguucugcuuccucugaagccgacgagagggccguugguagcuuugauguguggguccgcuuacaagaaccugauggccagcccuaugacaucuuugguaagcagccagccccaauuggcaccccugauuucaaggccgugauaguuggcuuugcagcuaggccccucacauccggguccuacgcaaaugaagcguauguuaacaccacagccagugacuacgccccagccacugguaauaugcgcuucacagucaggaacggcgggaccgggcacauaucugcaaacaaauacugggaguucaaaucauuugguguugaaggagaaaggcacacugacauccaguaccaggaguaugagcuucccgauuauucuggucaaguugcuuccaaccauaaucuggcccccccuguagccccacgcaugccuggugagucacuauugcuuuuccaaucaaauaugccugugugggaugaugggcguggagaguccacacccaagaagauucauugccuauugccacaggaguuuauuggccauuucuuugacaagcaagcccccucucuaggugaugcugcacugcuuagguaugucaaccaggagacaaauagaguguuguuugaguguaaacuuuauagggauggcuacaucacaguugcugcaucaucaggauuauuagauuuccccuuggauggcuucuuuagguuugauucuuggguuaguucuuuuuacauuuuaucccccgugggaagcggccaaggccgcagguaa

SEQ ID NO: 6788 - RNA, 1653 nt, Artificial Sequence
  VP1__Norovirus_and/or_Norovirus-like__DQ093067
augaagauggcgucgaaugacgcugcuccaucuacggauggugcgggcaaccucgucccagagagucaacaagagguguugccccucgcccccguugcaggcgccgcacuagcggcacccguaguggggcagacaaauauaauugaccccuggauuaaagaaaauuuuguucaagccccccaaggugaguucacagucucaccuaaaaauucuccuggugaaauuuugguuaauuuggaauugggacccaaacuuaaccccuaccuggaccaccuuucacguauguacaauucauaugcuggagguauagauguuauggugguguuggcgggcaacgccuucacagcugguaagguuuuaauagcagccauccccccaaauuucccaguagaaggagugucugcuucacaggccacucaguuuccccaugugguuauagauguuagaacacuugaccccgugcgucuuccccucccagacgugcgguccacauucuuccacuacaccaaugacacugaaccgaaaaugagguugguuauuuggcuuuauaccccacuuagaacuaauggcaguggugaugauucuuucaccguuucugggcgcauacucacgaggccuucucaggauuuugaguuugcguuucucauucccccaacaguggaaacaaagacaacccccuuuucagugccaggcuucucagugcaggagauguccaacucaagguggccggcugccaucucugcuaugguuguccguggaaaugagccccaaguuguccaguuccagaaugguagggcccaccuggacgguauguuacuuggcacgacccccgugucgcccaacuacauagcauccuaccgaggcauuucuacuggcaacucccguuccgccuccucugaggccgacgagagggcuguuggcagcuucgauguguggguccgcuugcaagaaccugacggacagcccuaugacaucuuuggcaaacagccagccccaauuggcaccccugacuucaaggccgugauaguuggcuuugcagcuaggccucuuacaucuggguccuacgcaaaugaagcguauguuaacaccacagccagugacuaugccccagccacugguaauaugcgcuucacggucaggaacggugggaccgggcacauaucugcaaauaaauacugggaguucaaaucauuugguguugaaggagagggacacacuaacauccaguaucaggaguaugaacuuccugauuacucuggucagguugcuucuaaucacaaccuggccccucccguggccccacguaugccuggugaaucucuguugcuuuuccaaucaaguaugccugugugggacgaugggcauggugaguccacaccuaagaagauccauugccuguugccgcaagaauucauuggccauuucuuugauaaacaagcccccucccuaggugaugcugcacugcucagguaugucaaucaagaaacaaacagggugcuguuugaaugcaaacuuuacagggaugguuacaucacuguugcugcaucaucaggauuauuggauuuccccuuggauggauucuuuagguuugauucuuggguuaguucuuucuauaucuugucccccgugggaagcggccaaggucgaagguaa

SEQ ID NO: 6789 - RNA, 1653 nt, Artificial Sequence
  VP1__Norovirus_and/or_Norovirus-like__AF195847
augaagauggcgucgagugacgcugcuccaucugcggauggugcgggcaaccucgucccagagagucaacaagagguauugccccucgcccccguugcgggcgcugcacuagcggcacccguaguggggcagacaaacauaauugaccccuggauuaaagaaaauuuuguucaagccccccagggugaguuuacagucucaccuaaaaauucuccuggugaaauuuuagucaauuuggaauugggacccaaacucaaccccuaucuggaucaccucucacgcauguacaauucauaugcuggugguauagauguuauggugguguuggcggguaacgccuucacagccgguaagguucuaauagcagccauccccccaaauuuuccaguagaaggaguguccgccucccaggccacucaguucccccaugugaucauagauguuagaacacuugacccugugcgucuuccacucccagacgugcggucuacauucuuccauuacaccaaugacacugaaccaaaaaugagguugguuauuuggcucuauaccccacuuagaacuaauggcaguggugaugauucuuucaccgucucugggcgcauacucacaaggcccucccaggauuuugaguuugcauuccuuauucccccaacaguggaaacaaagacaacccccuuuucagugccaggcuucucagugcaggagauguccaacucuagguggccggccgccaucucugcgaugguuguccgaggaaaugagccccagguuguccaguuccagaaugguagggcccaccuggaugguauguuacuugguacgacacccgugucgcccaacuacauagcauccuaucgagguauuuccaccggcaacucucgcucugcuuccccugaagccgacgagagggcuguuggcagcuucgauguguggauccgcuuacaagaaccugauggacagcccuaugacaucuuuggcaaacagccagccccaauuggcaccccugacuucaaggccgugauaguuggcuuugcagcuaggccccucacauccggguccuacgcaaacgaagcguauguuaacaccacagccagugacuaugccccagccacugguaacaugcgcuucacggucaggaaugguggguccgggcacauaucugcaaacaaauacugggaguucaaaucauuugguguugaaggagagaggcacacugacauccaguaucaggaguacgagcuuccugauuacucuggccagguugcuuccaaccacaaccuggccccccccguggccccacgcaugccuggugagucucuauugcuuuuccaaucaaauaugccugugugggacgaugggcauggugaguccacacccaagaagauccacugccugcugccacaagaauucauuggccacuucuuugauaaacaggcccccucccuaggugaugcugcauugcucagguaugucaaucaagagacaaacagggugcuguuugagugcaaacuuuauagggaugguuacaucacuguugcugcaucaucaggguugcuagauuuccccuuggauggauucuuuagguuugauucuuggguuaguucuuucuacauuuuauccccugugggaagcggccaaggccgaagguaa

SEQ ID NO: 6790 - RNA, 1653 nt, Artificial Sequence
  VP1__Norovirus_and/or_Norovirus-like__JQ970479
augaagauggcgucgagugacgcugcuccaucugcggauggugcgggcaaccucguuccagagagucaacaagagguguugccccucgccccaguugcaggcgcugcgcuagcggcaccugugguggggcaaacaaauauaauugaccccuggauuaaagaaaauuuuguucaagccccccagggugaguucacugucucaccuaaaaauucuccuggcgaaauuuugguuaauuuggaauugggacccaaacucaaccccuaucuagaccaccucucacgcauguacaauucauaugcugguggcauagaugucauggugguguuggcgggcaacgccuucacagccggcaagguuuugauagcagcuauccccccaaauuucccaguugaaggaguguccgcuucacaggccacucaauucccccaugugaucauagauguuaggacacuugacccuguucggcuuccccucccggaugugcgaucuacauucuuccacuacacuaaugauacugaaccaaaaaugagguuaguuauuuggcuuuacaccccacuuagaacuaauggcaguggugaugauucuuucaccgucucugggcgcauacucacaaggcccucccaggacuuugaauuugcuuuucuuauccccccaacaguggaaacaaagacaacccccuucucagugccgggcuucucggugcaggaaauguccaacucaagguggccagcugccaucucugcaauggucguccgugggaaugagccccaaguuguucaguuccagaauggcagggcccaccuagaugguaugcugcuugguacgacaccugugucgcccaauuacauagcauccuaccgaggcauuuccacuggcaacucucguucugcuuccucugaggccgacgagagggcuguugguagcuuugauguguggauccgcuuacaagaaccugauggccagcccuaugacaucuuugguaagcagccagccccaauuggcaccccugauuucaaggccgugauaguuggcuuugcagcuaggccccucacauccggguccuacgcaaaugaagcguaugucaacaccacagccagugacuacgccccagccacugguaauaugcgcuucacagucaggaacggcgggaccgggcacauaucugcaaacaaauacugggaguucagaucauuugguguugaaggagaaaggcacacugauguccaguaccaggaguaugagcuucccgauuauucuggucaaguugcuuccaaccauaauuuggcccccccuguggccccacgcaugcccggugagucauuauugcuuuuccaaucaaauaugccugugugggaugaugggcgcggagaguccacacccaagaagauucauugccuacugccacaggaguucauuggucauuucuuugauaagcaagccccuucccuaggugaugcugcacuacuuagguaugucaaccaggagacaaauagaguguuguuugaguguaaacuuuauagggaugguuacaucacaguugcugcagcaucaggauuacuagacuucccuuuggauggauucuuuagguuugauucuuggguuaguucuuuuuacauuuuaucccccgugggaagcggccaaggccgcagguaa

SEQ ID NO: 6791 - RNA, 1653 nt, Artificial Sequence
  VP1__Norovirus_and/or_Norovirus-like__FM865412
augaagauggcgucgagugacgcugcuccaucuacggauggugcgggcaaccucguuccagagagucaacaagagguguugccccucgccccaguugcaggcgcugcguuagcggcaccugugguggggcaaacaaauauaauugaccccuggauuaaagaaaauuuuguucaagccccccagggugaguuuacugucucaccuaaaaauucuccuggugaaauuuuaguuaauuuggaauugggacccaaacucaaccccuaucuggaccaccuuucgcgcauguacaacucauaugcugguggcauagaugucauggugguguuggcgggcaacgccuucacagccggcaagguuuuaauagcagcuauccccccaaauuucccaguggaaggaguguccgcuucacaggccacucaauuuccccaugugauuauagauguuaggacacuugacccugugcggcucccccucccggaugugcgauccacauucuuccacuacacuaaugauacugaaccaaaaaugagguuaguuauuuggcuuuacaccccacucagaacuaauggcaguggugaugauucuuucaccgucucugggcgcauacucacaaggcccucccaggacuuugaauucgcuuuccuuauccccccaacaguggaaacaaagacaacccccuucucagugccaggcuucucggugcaggaaauguccaacucaagguggccagcugccaucucugcaauggucguccgugggaaugaaccccaaguuguucaguuccagaacggcagggcccaucuggaugguaugcugcuugguacgacaccugugucgcccaauuacauagcauccuaccgaggcauuuccacuggcaacucucguucugcuuccucugaggcugacgagagggcuguugguagcuuugauguguggguccgcuuacaagaaccugauggccagcccuaugacaucuuugguaagcagccagccccaauuggcaccccugauuucaaggcugugauaguuggcuuugcagcuaggccccucacauccggguccuaugcaaaugaagcguauguuaacaccacagccagugacuacgccccagccacugguaauaugcgcuucacagucaggaacggugggaccgggcacauaucugcaaacaaauacugggaguucaaaucauuugguguugaaggagaaaggcacacuaacauccaguaccaggaguaugagcuucccgauuauucuggccaaguugcuuccaaccauaaucuggcccccccuguagccccacgcaugccuggugagucauuauugcuuuuccaaucaaauaugccugugugggaugaugggcauggagaguccacacccaagaagauucauugccuauugccacaggaguuuauuggccauuucuuugauaaacaagcccccucccuaggugaugcugcacuacuuagguaugucaaccaggagacaaauagaguguuguuugaguguaaacuuuauagggaugguuacaucacagucgcugcaucaucaggauuauuagauuucccuuuggauggauucuuuagguuugauucuuggguuaguucuuuuuacauuuuaucccccgugggaagcggccaaggccgcagguaa

SEQ ID NO: 6792 - RNA, 1653 nt, Artificial Sequence
  VP1__Norovirus_and/or_Norovirus-like__AF414426
augaagauggcgucgagugacgcugcuccaucuacggauggugcgggcaaccucguuccagagagucaacaagagguauugccccucgccccaguugcaggcgcugcacuagcggcaccugugguggggcagacaaauauaauugaccccuggauuaaagaaaacuuuguucaagccccucagggugaguuuacugucucaccuaaaaauucuccuggugaaauuuuaguuaauuuggaauugggacccaaacucaacccuuaucuagaccaccuuucacguauguacaauucauaugcugguggcauagaugucaugguaguguuggcgggcaacgccuucacagccggcaagguuuuaauagcagcuauccccccaaauuuuccaguggaaggaguguccgcuucacaggccacucaauuuccccaugugauuauagauguuaggacacuugacccugugcggcuuccccucccggaugugcgauccacauucuuccauuacaccaaugauacugaaccaaaaaugagguuaguuauuuggcuuuacaccccacucagaacuaauggcaguggugaugauucuuucaccgucucugggcgcauacucacaaggcccucccaggauuuugaauuugcuuuccuuaucccuccaacaguggaaacaaagacaacccccuuuucagugccgggcuucucagugcaagaaauguccaacucaagguggccagcugccaucucugcaauggucguccgugggaaugagccccaaguuguucaguuccagaaugguagggcccaucuggaugguaugcugcuuggcacgacacccgugucgccuaacuacauagcauccuaccgaggcauuuccacugguaacucucgcucugcuuccucugaggcugacgagagggccguugguaguuuugauguguggguccgcuuacaagaaccugauggccagcccuaugacaucuuugguaagcagccagccccaauuggcaccccugauuucaaggccgugauaguuggcuuugcagcuaggccccucacauccggguccuacgcaaaugaagcguaugucaacaccacagccagugacuacgccccagccacugguaauaugcgcuucacagucaggaacggcgggaccgggcacauaucugcaaauaaauacugggaguucaaaucauuuggcguugagggaaaaaggcacacuaguauccaguaccaggaguaugaacuucccgauuauucuggucaaguugcuuccaaccauaaucuggcccccccuguagccccacgcaugccuggugagucccuauugcuuuuccaaucaaauaugccugugugggaugaugggcauggagaguccacacccaagaagauccauugccuguugccacaggaguucauuggccauuucuuugacaagcaagcccccucccuaggugaugcugcacuacuuagguaugucaaccaggagacaaauagaguguuguuugaguguaaacuuuauagagaugguuacaucacaguugcugcaucaucaggauuauuggauuuccccuuggauggauucuuuagguuugauucuuggguuaguucuuuuuauauuuuaucccccgugggaagcggccaaggccguagguaa

SEQ ID NO: 6793 - RNA, 1653 nt, Artificial Sequence
  VP1__Norovirus_and/or_Norovirus-like__AF414427
augaagauggcgucgagugacgcugcuccaucugcggauggugcgggcaaccucgucccagagagucaacaagagguauugccccucgcccccguugcgggcgcugcacuagcggcacccguaguggggcagacaaacauaauugaccccuggauuaaagaaaauuuuguucaagccccccaaggugaguuuacagucucaccuaaaaacucuccuggugaaauuuuagucaauuuggaauugggacccaaacucaaccccuaucuggaucaccuuucacguauguacaauucauaugcuggugguauagauguuauggugguguuggcggguaacgccuucacagccgguaagguucuaauagcagccauucccccaaauuuuccaguagaaggaguguccgccucccaggccacucaguucccccaugugaucauagauguuagaacacuugacccugugcgucuuccacucccagacgugcgaucuacauucuuccauuacaccaaugacacugaaccaaaaaugagguugguuauuuggcucuauaccccacuuagaacuaauggcaguggugaugauucuuucaccgucucugggcgcauacucacaaggcccucccaggauuuugaguuugcauuccuuauucccccaacaguggaaacaaagacaacccccuuuucagugccaggcuucucagugcaggagauguccaacucuagguggccggccgccaucucugcgaugguuguccgaggaaaugagccucagguuguccaguuccagaaugguagggcccaccuggaugguauguuacuugguacgacacccgugucgcccaacuacauagcauccuaucgagguauuuccaccggcaacucucgcucugccuccacugaggccgacgagagggcuguuggcagcuucgauguguggauccgcuuacaagaaccugauggacagcccuaugacaucuuuggcaagcagccagccccaauuggcaccccugacuucaaggccgugauaguugguuuugcagccaggccccuuacauccggguccuacgcaaaugaagcguauguuaacaccacagccagugacuaugccccagccacugguaacaugcgcuucacggucaggaaugguggauccgggcacauaucugcaaacaaauacugggaguucaaaucauuugguguugaaggagagaggcacacugauauccaguaucaggaguacgagcuuccugauuacucuggccagguugcuuccaaccacaaccuggccccccccguggccccacgcaugccuggugagucucuauugcuuuuccaaucaaauaugccugugugggacgaugggcauggugaguccacacccaagaagauccacugccugcugccacaagaauucauuggccacuucuuugauaaacaggcccccucccuaggugaugcugcauugcucagguaugucaaucaagagacaaacagggugcuguuugagugcaaacuuuauagggaugguuacaucacuguugcugcaucaucaggguugcuagauuuccccuuggauggauucuuuagguuugauucuuggguuaguucuuucuacauuuuauccccugugggaagcggccaaggccgaagguaa

SEQ ID NO: 6794 - RNA, 1653 nt, Artificial Sequence
  VP1__Norovirus_and/or_Norovirus-like__JQ613567
augaagauggcgucgagugacgcugcuccaucuacggauggugcgggcaaccucguuccagagagucaacaagagguguugccccucgccccaguugcaggcgcugcguuagcggcaccuguggugggacaaacaaauauaauugaccccuggauuaaagaaaauuuuguucaagccccccagggugaguuuacugucucaccuaaaaauucuccuggugaaauuuuaguuaauuuggaauugggacccaaacucaaccccuaucuagaccaccuuucacgcauguauaauucauaugcuggugguauagaugucauggugguguuggcgggcaacgccuucacagccggcaagguuuuaauagcagcuauccccccaaauuucccaguggaaggaguguccgcuucacaggccacucaauucccccaugugauuauagauguuaggacacuugacccugugcggcucccccucccggaugugcgauccacguucuuccauuauacuaaugauacugaaccaaagaugagguuaguuauuuggcuuuacaccccacuuagaacuaauggcaguggugaugauucuuucacugucucugggcgcauacucacaaggcccucccaggacuuugaguuugcuuuccuuauccccccaacaguggaaacaaagacaacccccuuuucagugccaggcuucucagugcaggaaauguccaacucaagguggccagcugccaucucugcaauggucguccgugggaaugagccccaagucguucaguuccagaauggcagggcccaucuggaugguaugcugcuugguacgacaccugugucgcccaauuacauagcauccuaccgaggcauuuccacuggcaacucucguucugcuuccucugaggccgacgagagggccguugguagcuuugauguguggguccgcuuacaagaaccugauggccagcccuaugacaucuuugguaagcagccagccccaauuggcaccccugauuucaaggccgugauaguuggcuuugcagccaggccccucacauccggauccuacgcaaaugaagcguauguuaacaccacagccagugacuacgccccagccacugguaauaugcgcuucacagucaggaacggcgggaccgggcacauaucugcaaacaaauacugggaguucaaaucauuugguguugaaggagaaaggcacacugacauccaguaccaggaguaugagcuucccgauuauucuggucaaguugcuuccaaccauaaucuggcccccccuguagccccacgcaugccuggugagucacuauugcuuuuccaaucaaauaugccugugugggaugaugggcauggagaguccacacccaagaagauucauugccucuugccacaggaguuuauuggccauuucuuugacaggcaagcccccucucuaggugaugcugcacuacuuagguaugucaaccaggagacaaauagaguguuguuugaguguaaacuuuauagggauggcuacaucacaguugcagcaucaucaggauuauuagauuuccccuuggauggcuucuuuagguuugauucuuggguuaguucuuuuuacauuuuaucccccgugggaagcggccaaggccgcagguaa

SEQ ID NO: 6795 - RNA, 1653 nt, Artificial Sequence
  VP1__Norovirus_and/or_Norovirus-like__KC894731
augaagauggcgucgagugacgcugcuccaucuacggauggugcgggcaaccucguuccagagagucaacaagagguguugccccucgccccaguugcaggcgcugcguuagcggcaccugugguggggcaaacaaauauaauugaccccuggauuaaagaaaauuuuguccaagccccccagggugaguuuacugucucaccuaaaaauucuccuggugaaauuuuagucaauuuggaauugggacccaaacucaaccccuaucuagaccaccuuucacgcauguacaauucauaugcugguggcauagaugucauggugguguuggcgggcaacgccuucacagccggcaagguuuuaauagcagcuauccccccaaauuucccaguggaagugguguccgcuucacaagccacucaauucccccaugugauuauagauguuaggacacuugacccugugcggcucccccucccggaugugcgauccacguucuuccauuacacuaaugauacugaaccaaagaugagguuagucauuuggcuuuacaccccacuuagaacuaauggcaguggugaugauucuuucaccgucucugggcgcauacucacaaggcccucccaggacuuugaguuugcuuuccuuauccccccaacaguggaaacaaagacaacccccuuuucagugccaggcuucucggugcaggaaauguccaacucaagguggccagcugccaucucugcaauggucguccgugggaaugagccccaagucguucaguuccagaaugguagggcccacuuggaugguauguugcuugguacgacaccugugucgcccaauuacauagcauccuaccgaggcaucuccacuggcaacucucguucugcuuccccugaggccgacgagagggccguugguagcuuugauguguggguccgccuacaagaaccugauggccagcccuaugacaucuuugguaagcagccagccccaauuggcaccccugauuucaaggccgugauaguuggcuuugcagcuaggccccucacauccggguccuacgcaaaugaagcguauguuaacaccacagccaguaacuacgccccagccacugguaauaugcgcuucacagucaggaacggcgggaccgggcacacaucugcaaacaaauauugggaguucaaaucauuugguguugaaggagaaaggcacacuggcauccaguaccaggaguaugagcuucccgauuauucuggucaaguugcuuccaaccauaaucuggcccccccuguagccccacgcaugccuggugagucacuauugcuuuuccaaucaaauaugccugugugggacgaugggcauggagaguccacacccaagaagauucauugccuauugccacaggaguuuauuggccauuucuuugacaagcaagcccccucucuaggugaugcugcacuacuuagguaugucaaccaggagacaaauagaguguuguuugaguguaaacuuuauagggauggcuacaucacaguugcugcaucaucaggauuauuagauuuccccuuggauggcuucuuuagguuugauucuuggguuaguucuuucuacauuuuaucccccgugggaagcggccaaggccgcagguaa

SEQ ID NO: 6796 - RNA, 1647 nt, Artificial Sequence
  VP1__Norovirus_and/or_Norovirus-like__AF427118
augaagauggcgucgaaugacgccgcuccaucuagugauggugcagccggccucgugccagaaaguaauaaugagguuauggcucuugaaccuguugcuggggcaucuuuagcugccccugugacuggucaaacuaauauaauugacccauggaucagaaugaauuuuguucaagccccaaauggagaauucacuguuuccccaagaaauuccccuggagaaguacuccuaaauuuggaauuggguccugaauuaaacccuuaucuggcacaccuaucuaggauguauaauggcuaugcuggggguauggaaguacagaucaugcuagcugggaaugcguucacugcugguaaacugaucuuugcugcugugcccccacauuuucccauugaaaauuugagucccccccagauuacaauguucccacaugugauuauagauguuagaacuuuagaaccuguguugcucccuaugccugacaucaggaauucuuucuuucacuuuauccagagggaugagccaaagaugagguugguggcaaugcuguacacgccacugagguccaacggaucuggggaugacguauucacagucuccugcaggguucugacccgccccacuccugauuucgauuucacuuacuuaguaccaccaacugucgagucaaagaguaagccuuucacuuuaccuauauuaacauugggagaguugacaaauucuagguuuccauuacccauugauguccuguauacuaauccaaaugaaagugcaauuguucaaugucagaaugguaggugcacccuggacggcgaguugcaggggacgacucaacuccuacccacaggcaucugugcguucaggggcaaagucacucaacaggugcaggaugaacaucggggcacacauuggaauaugacaguaaccaacuuaaaugguaccccguuugacccaacugaggaugucccugcuccacugggcaccccggauuucuccggccaaauuuaugggguaauuagucagaggaauaccaacacaguucccggugagggagaccucccggccaacagggcucaugaggcagugauugcaaccuacagucccaaauucacacccaaauugggcaauauucaauucagcacuugggaaacucaagaugugagcucuggacaacccaccaaguucaccccaguuggcuuggccuccguggaugcuaacucucauuuugaccaauggacccuccccagcuauucuggugcccuaacucuaaauaugaacuuggccccaucuguugccccagucuucccuggagagugucuuuuguucuuuagaucuuucaucccauuaaaggggggcuaugggaacccugcuauugauugcuugaugccacaggaauggguccagcaccucuaccaggagucggcaccaucccuuagugauguggcuuuagugagguaugugaacccagaaacugggcgcacccuuuuugaagccaaguugcacaggaauggauuucugacuguugcuaggaacagugcuggaccugucguggcccccacaaaugguuauuuuagauuugauucuuggguuaaccaauuuuacacuuuagcccccaugggaaaugguagugggcgcagaagaaugcaguaa

SEQ ID NO: 6797 - RNA, 1647 nt, Artificial Sequence
  VP1__Norovirus_and/or_Norovirus-like__AY237415
augaagauggcgucgaaugacgccgcuccaucuagugauggugcagccggccucgugccagaaaguaacaaugagguuauggcucuugaaccuguugcuggggcaucuuuagcugccccugugacuggucaaacuaauauaauugacccauggaucagaaugaauuuuguucaagccccaaauggagaauucacuguuuccccaagaaauuccccuggagaaguacuccuaaauuuggaauuggguccugaauuaaacccuuaucuggcacaccuaucuaggauguauaauggcuaugcuggggguauggaaguacagaucaugcuagcugggaaugcguucacugcugguaaacugaucuuugcugcugugcccccacauuuucccauugaaaauuugagucccccccagauuacaauguuuccacaugugauuauagauguuagaaccuuagaaccuguguugcucccuaugccugacaucaggaauucuuucuuucacuuuauucagagggaugagccaaagaugagguugguggcaaugcuguacacgccacugagguccaacggaucuggggaugauguauucacagucuccugcaggguucugacccgccccacuccugauuuugauuucacuuacuuaguaccaccaacugucgagucaaagaguaagccuuucacuuuaccuauauuaacauugggagaguugacaaauucuagguuuccauuacccauugauguccuguauacuaacccaaaugagagugcaauuguucaaugucagaaugguaggugcacccuggacggcgaguugcaggggacgacucaacuccuacccacaggcaucugugcguucaggggcaaagucacucaacaggugcaggaugaacaucggggcacacauuggaauaugacaguaaccaacuuaaauggcaccccguuugacccaacugaggaugucccugcuccacugggcaccccggauuucuccggccaaauuuaugggguaauuagucagaggaauaccaacacaguucccggugaaggaaaccucccggccaacagggcucaugaggcagugauugcaaccuacagucccaaauucacacccaaauugggcaauauucaauucagcacuugggaaacucaagaugugagcucuggacaacccaccaaguucaccccaguuggcuuggccuccguggaugcuaacucucauuuugaccaauggacccuccccagcuauucuggugcccuaacucuaaauaugaacuuggccccaucuguugccccaguuuucccuggagagugucuuuuguucuuuagaucuuucaucccauuaaaagggggcuaugggaacccugcuauugauugcuugaugccacaggaauggguccagcaucucuaccaggagucggcaccaucccuuagugauguggcuuuagugagguaugugaacccagaaacugggcgcacccuuuuugaagccaaguugcacaggaauggauuucugacuguugcuaggaacagugcuggaccugucguggcccccacaaaugguuauuuuagauuugauucuugggucaaccaauuuuacacuuuagcccccaugggaaauggcagugggcgcagaagaaugcaguaa

SEQ ID NO: 6798 - RNA, 1647 nt, Artificial Sequence
  VP1__Norovirus_and/or_Norovirus-like__AF504671
augaagauggcgucgaaugacgccgcuccaucuaaugauggugcagccggccucgugccagaaaguaacaaugagguuauggcucuugaacccguugcuggggcaucuuuagcugccccugugacuggucaaacuaauauaauugacccauggaucagaaugaauuuuguucaagccccaaauggagaauucacuguuuccccaagaaauuccccuggagaaguacuccuaaauuuggaauuggguccugaauuaaacccuuaucuggcacaccuaucuaggauguauaauggcuaugcuggggguauggaaguacagaucaugcuagcugggaaugcguucacugcugguaaacugaucuuugcugcugugcccccacauuuuccuauugaaaauuugagucccccccagauuacaauguucccacaugugauuauagauguuagaacuuuagaaccuguguugcucccuaugccugacaucaggaauucuuucuuucacuuuauccagagggaugagccaaagaugagguugguggcaaugcuguacacgccacugagguccaacggaucuggggaugauguauucacaguuuccugcaggguucugacccgcccuacuccugauuucgauuucacuuacuuaguaccaccaacugucgagucaaagaguaagccuuucacuuuaccuauauuaacauugggagaguugacaaauucuagguuuccauuacccauugauguccuguauacuaauccaaaugaaagugcaauuguucaaugucagaaugguaggugcacccuggacggcgaguugcaggggacgacucaacuccuacccacaggcaucugugcguucaggggcaaagucacucaacaggugcaggaugaacaucggggcacacauuggaauaugacaguaaccaacuuaaaugguaccccguuugacccaacugaggaugucccugcuccacugggcaccccggauuucuccggccaaauuuauggggugauuagucagaggaauaccaacacaguucccggugagggaaaccucccggccaacagggcucacgaggcagugauugcaaccuacagucccaaauucacacccaaauugggcaauauucaauucagcacuugggaaacucaagaugugagcucuggacaacccaccaaguucaccccaguuggcuuggccuccguggaugcuaacucccauuuugaccaauggacccuccccagcuauucuggugcccuaacucuaaauaugaacuuggccccaucugucgccccaguuuucccuggagagugucuuuuguucuuuagaucuuucaucccauuaaaggggggcuaugggaacccugcuauugauugcuugaugccacaggaauggguccagcaucucuaccaggagucggcaccaucccuuagugauguggcuuuagugagguaugugaacccagaaacugggcgcacccuuuuugaagccaaguugcacaggaauggauuucugacuguugcuaggaacagugcuggaccugucguggcccccacaaaugguuauuuuagauuugauucuuggguuaaccaauuuuacacuuuagcccccaugggaaaugguagugggcgcagaagaaugcaguaa

SEQ ID NO: 6799 - RNA, 1647 nt, Artificial Sequence
  VP1__Norovirus_and/or_Norovirus-like__KJ194504
augaagauggcgucgaaugacgcugcuccaucuaaugauggugccgccggccucgucccagagaucaacaaugaggcaauggcgcuagagccaguggcgggugcagcgauagcagcgccccucacuggccagcaaaauauaauugaucccuggauuaugaauaauuuugugcaagcaccugguggugaguuuacagugucaccuaggaauuccccuggugaagugcuucucaauuuggaauuaggcccagaaauaaaucccuauuuggcucaucuugcuagaauguacaaugguuaugcagguggauuugaagugcaagugguccuagcuggaaaugcguuuacagcaggaaagguuaucuuugcagcuauacccccuaauuucccuauugacaaucugagcgcggcacagaucacaauguguccgcacgugauuguggaugucaggcaguuggaaccaaucaaucucccgaugccugauguccgcaacaauuucuuucauuauaaucaagguucugauucaagauuacguuugguugcaaugcuguauacaccucuuagggcaaauaauucuggagaugauguuuucacugugucuuguaggguguuaacuaggcccagcccugauuucucauucaauuuucuugucccacccacuguggaaucaaagacaaagccuuuuacccuccccauuuuaaccaucucugaaauguccaauuccagguuuccaguuccaauugacucucugcacaccagcccaacugagaauauaguuguccagugccaaaaugggcgcgucacucuugacggugaguuaaugggcaccacccaacucuuaccgagccaaauaugugcuuucaggggcacacucacuagaucaacaagcagggccagugaccaagccgacacaccaacccccaggcaauucgaccaucguuggcacauacaauuggauaaucuaaauggaacucccuacgacccugcagaggacauaccagcuccuuugggcacaccagacuuccgggguaaggucuuuggcguggccagccagagaaaccccgacggcacaacaagggcacaugaagcaaaaguggacacaacaacuaaccgcuucaccccaaaauugggcuccuuagaaauaaucacugaaucugaagacuuugacacaaaccagucaacaaaauucaccccaguuggcgucggaguugacaaugaggaagaauuccaacaaugguccuuacccaacuauucuggucaguuuacucauaauaugaacuuagccccagcugucgcccccaauuuuccuggugaacagcuacuuuucuuccggucacagcugccauccucugguggguggucuaacgggauucuagacugccuggucccccaggaauggguucaacacuucuaccaggaaucagcccccgcccaaacgcagguggcccugguuagguaugucaacccugacacuggcagagugcuauuugaggccaagcuacacaaauuggguuuuaugacuauagcaaagaauggugacuccccaauaacugucccuccaaauggauacuuuagauuugaaucuuggguuaaccccuuuuauacacuugcccccaugggaacuggaaacgggcguagaaggauucaauaa

SEQ ID NO: 6800 - RNA, 1647 nt, Artificial Sequence
  VP1__Norovirus_and/or_Norovirus-like__KJ194500
augaagauggcgucgaaugacgcugcuccaucuaaugauggugccgccggccucgucccagagaucaacaaugaggcaauggcgcuagagccaguggcgggugcagcgauagcagcgccccucacuggccagcaaaauauaauugaucccuggauuaugaauaauuuugugcaagcaccugguggugaguuuacagugucgccuaggaauuccccuggugaagugcuucuuaguuuggaauuagguccagaaauaaaucccuauuuggcucaucuugcuagaauguacaaugguuaugcagguggauuugaagugcaagugguccuagcuggaaaugcguuuacagcagggaagauuaucuuugcagcuauacccccuaauuuuccuauugacaaucugagcgcggcacagaucacaaugugcccgcaugugauuguggaugucaggcaguuggaaccagucaaucucccgaugccugauguccgcaacaauuucuuucauuauaaucaaaguucugagucaagauuacguuugauugcaauguuguauacaccucuuagggcaaauaauucuggagaugauguuuucacugugucuuguaggguguuaacuaggcccagcccugauuucucauucaauuuucuugucccacccacuguggaaucaaagacaaaaccuuuuacccuccccauuuuaaccaucucugaaauguccaauuccagguuuccaguuccaauugacucucugcacaccagcccaacugagaauauaguuguccagugccaaaaugggcgcgucacucuugacggugaguuaaugggcaccacccaacucuuaccgagccaaauaugugcuuucaggggcacacucacuggaucaacaagcagggccagugaccaaacugacacaccaacccccaggcaauucgaccgucguuggcacauacaauuggauaaucuaaauggaacucccuacgacccugcagaggacauaccagcuccuuugggcacaccagacuuccggggcaaggucuuuggcguggccagccagagaaaccccgacagagcaacaagggcacaugaagcaaaaguggacacaacaucugaccgcuucgccccaaaauugggcuccuuagaaauaaccacugaaucuggugacuuugaagcaaaccagccaacaaaauucaccccaguuggcaucggaguugacaaugaggcagaauuucagcaaugguccuuacccaacuauucuggucagauuacucacaauaugaacuuagccccagcugucgcccccaauuuuccuggugaacagcuacuuuucuuccgaucacagcugccauccucuggugggugguccaacgggguucuagacugccugcucccccaggaauggguucaacacuuuuaccaagaaucagcccccgcccaaacgcagguggcccugguuagguaugucaacccugacacuggcagagugcuauuugaggccaagcuacacaaauuggguuuuaugacuauagcaaagaauggugacuccccaauaacugucccuccaaauggauauuuuagauuugaaucuuggguuaaccccuuuuacacacuugcccccaugggaacuggaaacgggcguagaaggauucaauaa

SEQ ID NO: 6801 - RNA, 1647 nt, Artificial Sequence
  VP1__Norovirus_and/or_Norovirus-like__DQ093063
augaagauggcgucgaaugacgcugcuccaucuaaugauggugccgccggccucgucccagagaucaacaaugaggcaauggcgcuagacccaguggcgggugcagcaauagcagcaccccuuacuggccagcaaaauauaauugaucccuggauuaugaauaacuuugugcaagcaccugguggugaguucacagugucaccuagaaauucuccuggugaaguguuacuuaauuuggaauuggguccagaaauaaaucccuacuuggcccaucuugcuagaauguacaauggcuaugcagguggguuugaaguacagguaguccuggcuggaaaugcauuuacagcaggaaaggugaucuuugcagccauaccccccaacuucccuauugauaaucugagcgcagcacagaucacaaugugcccgcaugugauuguggaugucaggcaacuggaaccaaucaaucucccaaugccugauguccgcaacaauuucuuucauuauaaucaagggucugauucaagauuacgcuuaauugcaaugcuguauacaccccuuagagcaaauaauucuggggaugauguuuucacugugucuuguagaguuuuaaccaggccuagcccugauuucucauuuaauuuucuugucccacccacuguggaaucaaagacaaaaccuuucacccuccccauuuugaccaucucugaaauguccaauuccagguuuccagugccaaucgacucccuacacaccagcccgaccgagagugucguuguccaaugccaaaaugggcgcgucacccucgauggugagcuaauggguaccacccaacucuugccaagucaaauaugugcuuucaggggcacacuuacuagaccaacaaauagggccagugaccaagcugacacagcaaccccuaggcuguucaaccaucaguggcacauacaauuggauaaucuaaauggaacccccuaugaucccgcagaggacauaccagcucccuuggguacaccagacuuccggggcaaggucuuugguguggccagucaaagagaccccgacggcacaacaagagcacaugaagcaaagguggacacaacaucuggucgcuucacuccaaaauuggguucccuagaaauaaccacugaaucugaugauuuuaaccaaaauaagccaacgagauucaccccaguuggcauuggaguugacaaugaggcagauuuccaacaauggaucuuaccugauuacuccggccaguuuacucauaauaugaauuuggccccagcugucgcccccaauuucccuggugagcaacuucuuuucuuccgcucacaguugccaucuucuggugggcggucgaacgggauucuagacugccuggucccccaagaauggguucaacacuucuaccaggaaucagcccccgcccagacacagguggcccugguuagauaugucaacccugacacugguagggugcuauuugaggccaagcuucacaaaaugggcuucaugacuauagcaaagaauggugauucuccaauaacugucccuccaaauggauacuuuagauuugaaucuugggugaaccccuuuuauacacucgcccccaugggaacuggcaaggggcguagaaggauucaauaa

SEQ ID NO: 6802 - RNA, 1647 nt, Artificial Sequence
  VP1__Norovirus_and/or_Norovirus-like__AY030313
augaagauggcgucgaaugacgcugcuccaucuaaugauggugccgccggccucgucccagagaucaacaaugaggcaauggcgcuagauccaguggcgggugcagcgauagcagcaccccucacuggccagcaaaauauaauugaucccuggauuaugaauaacuuugugcaagcaccugguggugaguuuacagugucaccuaggaauuccccuggugaagugcuucuuaacuuggaauuagguccagaaauaaaucccuauuuggcucaucuugcuagaauguacaaugguuaugcagguggguuugaagugcaagugguccuggcuggaaaugcguuuacagcaggaaaggugaucuuugcagcuauaccccccaacuucccuauugauaaucugagcgcagcacagaucacaaugugcccgcacgugauuguggaugucaggcaguuggaaccaaucaaucuuccgaugccugauguccgcaacaauuucuuucauuauaaucaagggucugauucaagauuacguuuaauugcaaugcuguauacaccucuuagggcaaauaauucuggagaugauguuuucacugugucuuguaggguguuaacuaggccuagcccugauuucucauucaauuuucuugucccacccacuguggaaucaaagacaaaaccuuuuacccuccccauuuuaaccaucucugaaaugucuaauuccagguuuccggugccaauugacucucugcacaccagcccaacugagaguaucguuguccagugccaaaaugggcgcgucacucuugacggugaguuaaugggcaccacccaacucuuaccgaaccaaauaugugcuuucaggggaacacuuacuagaucaacaaacagggccagugaccaagccgacacagcaacccccaggcuauuugaccaucauuggcacauacaauuggauaaucuaaauggaacccccuacgacccugcagaggacauaccagcuccuuuggguacaccagacuuccggggcaaagucuuuggcguagccagccagagaaaccccgacagcacaacaagggcacaugaagcaaaaguggacacaacaucuggccgcuucaccccaaaauugggcucccuagaaauaaccacugaaucugaugacuuugacccaaaccagucaacaaaauucaccccaguuggcauuggaguugacaaugaggcagauuuucagcaaugguccuuaccugacuauuccggucaguuuacucauaacaugaacuuagccccagcugucgcccccaauuuuccuggugaacagcuucuuuucuuccgaucacagcugccaucuucuggugggcggucuaacgggauucuagacugccuggucccccaggaauggguucaacacuucuaccaagaaucagcccccgcccagacacagguggcccugguuagguaugucaacccugacacugguagagugcuauuugaggccaagcuacacaaauuggguuuuaugacuauagcaaagaauggugacuccccaauaacugucccuccaaauggguauuuuagauuugaaucuuggguuaaccccuuuuacacacuugcccccaugggaacuggaaacgggcguagaaggauucaauaa

SEQ ID NO: 6803 - RNA, 1647 nt, Artificial Sequence
  VP1__Norovirus_and/or_Norovirus-like__U02030
augaagauggcgucgaaugacgcugcuccaucuaaugauggugccgccugccucgucccagagaucaacaaugaggcaauggcgcuagagccaguggccgguucagcgauagcagcuccccucacuggccagcaaaauauaauugaucccuggauuaugaauaauuuuguacaagcaccugguggugaguuuacagugucacccaggaauuccccuggugaagugcuucuuaacuuggaguuagguccagaaauaaauccuuauuuggcucaucucgcuagaauguacaaugguuaugcagguggauuugaagugcaagugguccuagcuggaaaugcguuuacagcaggaaagauuaucuuugcagcuauacccccuaacuucccuauugacaaucugagcgcggcacagaucacaaugugcccgcaugugauuguggaugucaggcaguuggaaccaaucaaucucccgaugccugauguccgcaacaauuucuuucauuacaaucaagguucugauucaagauuacguuugauugcaaugcuguauacaccucuuagggcaaauaauucuggagaugauguuuucacugugucuugcaggguguuaacuaggccuagcccugauuucucauucaauuuucuugucccacccacuguggaaucaaagacaaaaccuuucacccuccccauuuuaaccaucucugaaaugucuaauuccagguuuccggugccaauugacucucugcacaccagcccaacugagaauauaguuguccagugccaaaaugggcgcgucacucuugacggugaguugaugggcaccacccaacucuuaccgagccaaauaugugcuuucaggggcacacucacuagaucaacaagcagggccagugaccaagccgacacaccaaccccuaggcuauucaacuauuauuggcacauacaauuggauaaucugaauggaacucccuaugacccugcagaggacauaccagccccuuugggcacaccagacuuccggggcaaggucuucggcguagccagccagagaaaccccgacagcacaacaagggcacaugaagcaaaaguggacacaacaucuggccgcuucaccccaaaauugggcucccuagaaauaaccacugaaucugaugacuuugacccaaaccagccaacaaaguucaccccaguuggcguuggaguugacaaugaggcagaauuucagcaaugguccuuacccaacuauucuggucaguuuacucauaauaugaacuuagccccagcugucgcccccaauuuuccuggugaacagcuacuuuucuuccgaucacagcugccauccucuggugggcggucuaacgggguucuggacugccuggucccccaggaauggguucaacacuuuuaccaagaaucagcccccgcccaaacacagguggcccugguuagguaugucaacccugacacugguagagugcuauuugaggccaagcuacacaaauuggguuuuaugacuauagcaaagaauggugacuccccaauaacugucccuccaaauggauauuuuagauuugaaucuuggguuaaccccuuuuacacacuugcccccaugggaacuggaaacgggcguagaaggauucaauaa

SEQ ID NO: 6804 - RNA, 1647 nt, Artificial Sequence
  VP1__Norovirus_and/or_Norovirus-like__AB039782
augaagauggcgucgaaugacgcugcuccaucuaaugauggugccgccggccucgucccagagaucaacaaugaggcaauggcgcuagagccaguggcgggcgcagcgauagcagcgccccucacuggccagcaaaauauaauugaucccuggauuaugaauaauuuugugcaagcaccugguggugaguuuacagugucaccuaggaauuccccuggugaagugcuucuuaauuuggaauuagguccagaaauaaaccccuauuuggcucaucuugcuagaauguacaaugguuaugcagguggauuugaagugcaagugguccuagcuggaaaugcguuuacagcaggaaagguuaucuuugcagcuauacccccuaauuucccuauugacaaucugagcgcggcacagaucacaaugugcccgcacgugauuguggaugucaggcaguuggaaccaaucaaucucccgaugccugauguccgcaacaauuucuuucauuauaaucaagguucugauucaagauuacguuugauugcaauguuguauacaccucuuagggcaaauaauucuggagaugauguuuucacugugucuuguaggguguuaacuaggcccagcccugauuucucguucaauuuucuugucccacccacuguggaaucaaagacaaagcuuuuuacccuccccauuuuaaccaucucugaaauguccaauuccagguuuccaguuccaauugacucuuuacacaccagcccaacugagaauauaguuguccagugccaaaaugggcgcgucacucuugacggugaguuaaugggcaccacccaacucuuaccgagccaaauaugugcuuucaggggcacacucacuagaucaacaagcagggccagcgaccaagccgacacaccaaccccuaggcuauucaaccaucguuggcacauacaauuggacaaucuaaauggaacucccuacgacccugcagaggacauaccagcuccuuugggcacaccagacuuccggggcaaggucuuuggcguggccagccagagaaaccccgacagcacaacaagggcacaugaagcaaaaguggacacaacaucuggccgcuucaccccaaaauugggcuccuuagaaauaaccacugagucugaugacuuugacacaaaccagucaacaaaauucaccccaguuggcaucgggguugacaaugaggcagaauuucagcaaugguccuuacccaacuauucuggucaguuuacucauaauaugaacuuagccccagcugucgcccccaauuuuccuggugaacagcuacuuuucuuccgaucacagcugccauccucuggugggcggucuaacgggguccuagacugcuuggucccccaggaauggguucaacacuuuuaccaagaaucagcccccgcccaaacgcagguggcccugguuagguaugucaacccugacacuggcagagugcuauuugaggcuaagcuacacaaauuggguuuuaugacuauagcaaagaauggugacuccccaauuacugucccuccaaauggauacuuuagauuugaaucuuggguuaaccccuuuuacacacuugcccccaugggaacuggaaacgggcguagaaggauucaauaa

SEQ ID NO: 6805 - RNA, 1647 nt, Artificial Sequence
  VP1__Norovirus_and/or_Norovirus-like__U46039
augaagauggcgucgaaugacgcugcuccaucuaaugauggugccgccggccucgucccagagaucaacaaugaggcaauggcgcuagagccaguggcgggugcagcgauagcagcgccccucacuggccagcaaaauauaauugaucccuggauuaugaauaauuuugugcaagcaccugguggugaguuuacagugucaccuaggaauuccccuggugaagugcuucuuaauuuggaguuagguccagaaauaaaccccuauuuggcucaccuugcuagaauguacaaugguuaugcagguggauuugaagugcaagugguccuagcuggaaaugcguuuacagcaggaaagguuaucuuugcagcuauacccccuaacuucccuauugacaaucugagcgcggcacaaauuacaaugugcccgcacgugauuguggaugucaggcaguuggaaccaaucaaccucccgaugccugacguccgcaacaauuucuuucauuauaaucaagguucugauucaagauuacgcuugauugcaauguuguuuacaccucuuagggcaaauaauucuggagaugauguuuucacugugucuuguaggguguuaacuaggccuagcccugauuucucauuuaauuuucuugucccacccacuguggaaucaaagauaaaaccuuuuacccuccccauuuuacccaucucugaaauguccaauuccagguuuccggugccaauugacucucugcauaccagcccaacugagaauauaguuguccagugccaaaauggacgcgucacucuugacggugaguuaaugggcaccacccaacuauucccgagccaaauaugugcuuucaggggcacacucacuagaucaacaagcagggccagugaccaagccgacacaucaaccccuaggcuauucaacuauuauuggcacauacaauuggauaaucuaaauggaacucccuacgacccugcagaggacauaccagcuccuuugggcacaccagacuuccagggcaaggucuuugguguagccagccagagaaaccccgacagcacaacaagggcgcaugaagcaaaaguggacacaacaucuggccgcuucaccccaaaauugggcuccuuagagauaaguacugaaucugaugacuuugacucaaaccaaccaacaaaauucaccccaguuggcauuggaguugacaaugaggcagauuuucagcaaugguccuuacccaacuauucuggucaguuuacucauaauaugaacuuagccccagcugucgcccccauuuuuccuggugaacagauacuuuucuuccgaucacaggugccauccucugguggucggucuaacgggguucuagacugccuggucccccaggaauggguucaacacuuuuaccaagaaucagcccccgcccaaacacagguggcccugguuagguaugucaauccugacacugguagagugcuauuugaggccaagcuacacaaauuggguuuuaugacuauagcaaagaauggugacucuccaauaacugucccuccaaauggauauuuuagauuugaaucuuggguuaaccccuuuuauacacuugcccccaugggaacuggaaacgggcgcagaaggauucaauaa

SEQ ID NO: 6806 - RNA, 1647 nt, Artificial Sequence
  VP1__Norovirus_and/or_Norovirus-like__DQ093066
augaagauggcgucgaaugacgcugcuccaucuaacgauggugccgccggccucgucccagagaucaacaaugaggcaauggcgcuagacccaguggcgggugcagcgauagcagcgccccucacuggacagcaaaacauaauugaucccuggauuaugaauaauuuugugcaagcaccugguggugaguuuacagugucaccuaggaauuccccuggugaagugcuucuaaacuuagaauuaggcccagaaauaaaccccuauuuggcucaccuugcuaggauguauaaugguuaugcagguggguuugaagugcagguaguccuggcuggaaaugcguuuacagcaggaaaggugaucuuugcagcuauacccccuaauuuuccaauugauaaucugagcgccgcacagauuacaaugugcccucaugugauuguggacguuaggcaguuggaaccaaucaaccuuccgaugccugauguucgcaacaauuucuuucauuauaaucaagggucugauucaagguugcgcuuaauugcaauguuguauacaccucuuagggcaaacaauucuggagaugauguuuuuacugugucuuguagaguauuaacuaggccuaguccugauuucucauucaauuuccuugucccacccacuguggaaucaaagacaaagccuuucacccuccccauucugacuaucucugaaaugucuaauuccagguuuccggugccaauugacucucugcacaccagcccgacugagaacauuguuguccaaugucaaaaugggcgcgucacucuugacggugaguugauggguaccacccaacucuuaccgagucagauaugcacuuucaggggcacgcucaccaggucaacaagcagggccagugaccaagccgacacagcaaccccuaggcuauucaacuauuauuggcauauacaauuggacaaccuaaauggaacccccuacgacccugcagaggauauaccagccccucugggaacaccugauuuccggggcaaggucuuuggcguggccagccagagaaaccccgacagcacaacaagagcacaugaagcaaaaguggacacaacaucuggucgcuucaucccgaaauugggcucucuagaaaucuccacugaguccgaugauuuugaccaaaaccaaccaacaagguucaccccaguuggcauugggguugacaaugaggcagguuuucagcaaugguccuuaccugacuauucuggucaguuuacucacaacaugaacuuagccccagcugucgcccccaauuuuccuggugagcaacuucuuuucuuccgcucacagcugccaucuucuggugggaggucuaacgggauucuagacugccuggucccccaggaauggguucaacacuucuaccaggaaucugccccugcccaaacacaaguggcccugguuagguaugucaacccugacacugguagaguguuguuugaggccaaguuacauaaauuagguuucaugacuauaucuaagaauggugauuccccaauaacuguucccccaaauggguacuuuagauuugaaucuugggugaaccccuuuuauacacuugcccccaugggaacuggaaaugggcguagaaggauucaauaa

SEQ ID NO: 6807 - RNA, 1647 nt, Artificial Sequence
  VP1__Norovirus_and/or_Norovirus-like__DQ093062
augaagauggcgucgaaugacgcugcuccaucuaaugauggugccgccggccucgucccagagaucaacaaugaggcaauggcgcuagagccaguggcgggugcagcgauagcagcgccccucacuggccagcaaaauauaauugaucccuggauuaugaauaauuuugugcaagcaccugguggugaguuuacagugucaccuaggaauuccccuggugaagugcuucucaauuuggaauuagguccagaaauaaaucccuauuuggcucaucuugcuagaauguauaaugguuaugcagguggguuugaagugcaagugguccuagcuggaaaugcguuuacagcaggaaagguuaucuuugcagcuauacccccuaauuucccuauugacaaucugagcgcggcacagaucacaaugugcccgcacgugauuguggaugucaggcaguuagaaccaaucaaucucccgaugccugauguccgcaacaauuucuuucauuauaaucaagguucugauucaagauugcguuugauugcaauguuguauacaccucuuagggcaaauaauucuggagaugauguuuucacugugucuuguaggguguuaacuaggcccaguccugauuucucauucaauuuucuugucccacccacuguggaaucaaagacaaagcuuuuuacccuccccauuuuaaccaucucugaaauguccaauuccagguuuccgguuccaauugauucuuuacacaccagcccaacugagaauauaguuguccagugccaaaaugggcgcgucacucuugacggugaguuaaugggcaccacccaacucuuaccgagccaaauaugugcuuucaggggcacacucacuagaccaacaagcagggccagugaccaagccgacacaccaacccccaggcuauucaaccaucguuggcacauacaauuggacaaucuaaauggaacucccuaugaccccgcggaggacauaccagcuccuuugggcacaccagacuuccggggcaaggucuuuggcguggccagccagagaaaccccgacagcacaacaagggcacaugaagcaaaaguggacacaacaucuggccgcuucaccccaaaauuggguuccuuagaaauaaccacugagucugaugacuuugacacaaaccagucaacaaaauucaccccaguuggcaucgggguugacaaugaggcagaauuucagcaaugguccuuacccaacuauucuggucaguucacucauaauaugaacuuagccccagcugucgcccccaauuuuccuggugagcagcuacuuuucuuccgaucacagcugccauccucuggugggcggucuaacgggguucuagacugccuggucccccaggaauggguacaacacuuuuaccaagaaucagcccccgcccaaacacagguggcccugguuaaguaugucaacccugacacuggcagagugcuauuugaggcuaagcuacacaaguuggguuuuaugacuauagcaaagaauggugacuccccaauaacugucccuccaaauggauacuuuagauucgaaucuuggguuaaccccuuuuacacacuugcccccaugggaacuggaaacgggcguagaaggauucaauaa

SEQ ID NO: 6808 - RNA, 1647 nt, Artificial Sequence
  VP1__Norovirus_and/or_Norovirus-like__GU930737
augaagauggcgucgaaugacgcugcuccaucgaaugauggugcugccaaccucguaccagaggccaacagugagguuauggcacuugaaccgguggugggagccucaauugcagcuccugucgucggucaacagaauauaauugaccccuggauuagagaaaauuuuguucaggcaccacagggugaguuuacuguuucaccaaggaacucaccuggugagaugcuuuuaaaucuugaauuaggcccagagcuuaacccuuaucugagucauuugucccgcauguacaacggcuaugcuggugguaugcagguucaggugguccuagcugggaaugcguucacagcugguaaaaucaucuuugccgccguuccaccacauuucccuguagagaauauuagugcagcccaaaucacaaugugcccccaugugaucguugauguaagacagcuugagccagugcuuuugccccucccugacauaaggaauagauucuuucauuauaaucaggaagacaccccccggaugagacuuguggcuauguuauacacaccccuuagagcaaauucuggugaggauguauucacagugucuugcagggucuugacccgcccagcccccgauuuugaguucacguucuuagugccaccaacuguggagucaaagaccaagccuuucacacucccuauucugacucuuggagagcuauccaacuccagauuccccgcuccaauagauaugcuguacacagauccuaaugaggcaauugugguacaaccacaaaauggcaggugcacccuagacggaacacuucaagggaccacccagcuggugcccacccaaauuugcuccuucaggggcacgcucauuagccagacgucgaggucugcagauucaacagauucagcuccacggguaaggaaccacccucuucacguucagcugaagaaccucgaugggacaccauaugauccaacagaugaggugccggcgguucuaggugccauagauuucaagggaacuguguuuggaguugcuagccaaagaaacaccacaggaaacucugaagagggcgcgacccgcgcccaugaaguacacauugacaccacaaacccuagauacaccccaaaacuuggcucuguguuuaugcauucugaguccacugauuuugaugauggacagcccacccgcuuuaccccuauuggcaugggagccgaugauuggcgccaaugggaguugccugaauacucuggucaccucacucuuaacaugaaccuggcccccgcaguugccccugcuuuccccggugagcgcauccucuucuucaggucaguugugccuucugcuggugguuaugggucgggccagauagauugccucaucccacaggaauggguucagcacuucuaucaggaggccgccccaucacaaucugcgguggcucucauuagauaugucaaccccgacacugggagaaacaucuuugaggcaaagcuacauagagagggguucaucacuguggcaaauucuggaaacaaccccauaguugugcccccaaaugguuacuucagguucgaggcuuggguuaaucaauuuuacacacucacccccaugggaacuggacaggggcgcagaagaguucaauaa

SEQ ID NO: 6809 - RNA, 1647 nt, Artificial Sequence
  VP1__Norovirus_and/or_Norovirus-like__AF414412
augaagauggcgucgaaugacgcugcuccaucuagugauggugccgccggccucgucccagagaucaacaaugaggcaauggcgcuagagccaguggcgggugcagcgauagcagcgccccucacuggccagcaaaauauaauugaucccuggauuaugaauaauuuugugcaagcaccugguggugaguuuacagugucaccuaggaauuccccuggugaagugcuucuuaauuuggaauuaggcccagaaauaaaucccuauuuggcucaucuugcuagaauguacaaugguuaugcagguggauuugaagugcaagugguccuagcuggaaaugcguuuacagcaggaaagguuaucuuugcagcuauacccccuaauuucccuauugacaaucugagcgcggcacagaucacaauguguccgcacgugauuguggaugucaggcaguuggaaccaaucaaccucccgaugccugauguccgcaacaauuucuuucauuauaaucaagguucugauucaagauuacgcuugauugcaaugcuguauacaccucuuagggcaaacaauucuggagaugauguuuucacugugucuuguaggguguuaacuaggccuagcccugauuucucauuuaauuuucuugucccacccacuguggaaucaaagacaaaacuuuuuacccuccccauuuuaaccaucucugaaaugucuaauuccagguuuccggugccaauugacucucugcacaccagcccaacugagaauauaguuguccagugccaaaaugggcgcgucacucuugacggugaguuaaugggcaccacccaacucuuaccaagccaaauaugugcuuucaggggcacacucacuagaucaacaagcagggccagugaccaagccgacacaccaaccccuaggcuauucaacuauuauuggcacauacaauuggauaaucuaaauggaacucccuacgacccugcagaggacauaccagcuccuuugggcacaccggacuuccggggcaaggucuuuggcguagccagccagagaaaccccgacagcacaacaagggcacaugaagcaaaaguggacacaacaucuggccgcuucaccccaaaauugggcuccuuagaaauaagcacugaaucugaugacuuugacccaaaccagccaacaaaauucaccccaguuggcauuggaguugacaaugaggcagauuuucaacaaugguccuuaccuaacuauucuggucaguuuacucauaauaugaauuuagccccagcugucgcccccaauuuuccuggugaacagcuacuuuucuuccgaucacagcggccauccucuggugggcggucuaacgggauucuagacugccuggucccccaggaauggguucaacacuuuuaccaagaaucggcccccgcacaaacacagguggcccugguuagguaugucaacccugacacugguagagugcuauuugaggccaagcuacacaaauuggguuuuaugacuauagcaaagaauggugauuccccaauaacugucccuccaaauggauauuuuagauuugaaucuuggguuaaccccuuuuacacacuugcccccaugggaacuggaaacgggcguagaaggauucaauaa

SEQ ID NO: 6810 - RNA, 1647 nt, Artificial Sequence
  VP1__Norovirus_and/or_Norovirus-like__AB039781
augaagauggcgucgaaugacgcugcuccaucuaaugauggugccgccggccucgucccagagaucaacaaugaggcaauggcgcuagagccaguggcgggcgcagcgauagcagcgccccucacuggccagcaaaauauaauugaucccuggauuaugaauaauuuugugcaagcaccugguggugaguuuacagugucaccuaggaauuccccuggugaagugcuucuuaauuuggaauuagguccagaaauaaaccccuauuuggcucaucuugcuagaauguacaaugguuaugcagguggauuugaagugcaagugguccuagcuggaaaugcguuuacggcaggaaagguuaucuuugcagcuauacccccuaauuucccuauugacaaucugagcgcggcacagaucacaaugugcccgcacgugauuguggaugucaggcaguuggaaccaaucaaucucccgaugccugauguccgcaacaauuucuuucauuauaaucaagguucugauucaagauuacguuugauugcaauguuguauacaccucuuagggcaaauaauucuggagaugauguuuucacugugucuuguaggguguuaacuaggcccagcccugauuucucguucaauuuucuugucccacccacuguggaaucaaagacaaagcuuuuuacccuccccauuuuaaccaucucugaaauguccaauuccagguuuccaguuccaauugacucuuuacacaccagcccaacugagaauauaguuguccagugccaaaaugggcgcgucacucuugacggugaguuaaugggcgccacccaacucuuaccgagccaaauaugugcuuucaggggcacacucacuagaucaacaagcagggccagcgaccaaaccgacacaccaaccccuaggcuauucaaccaucguuggcacauacaauuggacaaucuaaauggaacucccuacgacccugcagaggacauaccagcuccuuugggcacaccagacuuccgggguaaggucuuuggcguggccagccagagaaaccccgacagcacaacaagggcacaugaagcaaaaguggacacaacaucuggccgcuucaccccaaaauugggcucuuuagaaauaaccacugagucugaugaccuugacacaaaccagucaacaaaauucaccccaguuggcaucgggguugacaaugaggcagaauuucagcaaugguccuuacccaacuauucuggucaguuuacucauaacaugaacuuagccccagcugucgcccucaauuuuccuggugaacagcuacuuuucuuccgaucacagcugccauccucuggugggcggucuaacgggguucuagacugcuuggucccccaggaauggguucaacacuuuuaccaagaaucagcccccgcccaaacgcagguggcccugguuagguaugucaacccugacacuggcagagugcuauuugaggcuaagcuacacaaauuggguuuuaugacuauagcaaagaauggugacuccccaauaacugucccuccaaauggauacuuuagauuugaaucuuggguuaaccccuuuuauacacuugcccccaugggaacuggaaacgggcguagaaggauucaauaa

SEQ ID NO: 6811 - RNA, 1647 nt, Artificial Sequence
  VP1__Norovirus_and/or_Norovirus-like__LC035073
augaagauggcgucgaaugacgccacuccaucuaaugauggugccgccggccucgucccagagaucaacaaugaggcaauggcgcuagauccaguggcgggugcagcgauagcagcaccccucacuggccagcaaaauauaauugaucccuggauuaugaacaauuuugugcaagcaccugguggugaguucacagugucgccuaggaauuccccuggugaagugcuccucaauuuggaauugggcccagagauaaaccccuaucuggcccaucuugcuagaauguacaaugguuaugcagguggguuugaagugcagguaguccuagcuggaaaugcguuuacagcaggaaagauaaucuuugcagcuauacccccuaacuucccaauugacaaucuaagugcagcacagaucacaaugugcccacaugugauuguggaugucaggcaguuggaaccggucaaccucccgaugccugacguucgcaauaacuucuuccacuacaaccaagggucugauucgagauugcgcuugauugcaaugcuguacacaccucuuagggcaaauaacucuggggaugacgucuucacugugucuuguagagugcugacuaggccuagcccugaauuuucauuuaauuuccuugugccacccacuguggagucaaagacaaaacccuucacccucccaauucugacuaucucugaaaugucuaauucuagguuuccagugccgauugauucucugcacaccagcccaacugagaauauugucguccagugccaaaauggacgcgucacucuugauggugaguugaugggcaccacucagcucuuaccuagucaaaucugugcuuucaggggcgugcucacuagaucaacaagcagggcuagugaccaggccgacacagcaaccccuagauuguuuaauuauuauuggcacauacaauuggauaaucuaaaugggacuccuuaugauccugcagaagacauaccaggcccccuggggacaccagauuuccggggcaaagucuuuggcguggccagccaaagaaaccccgacaguacaacuagagcacaugaagcaaagguggacacaacaucuggucgcuucaccccaaaacuaggcucauuagagauauccacugaaucugaugacuuugaccaaaaccaaccaacaagauucaccccaguuggcauuggaguugaucacgaggcagacuuccaacaaugguccuuacccgacuacucuggccaguucacucacaacaugaacuuagccccagcuguugcucccaacuucccuggugagcagcuccuuuucuuccgcucacaguuaccaucuucuggugggcgauccaaugggauucuagacugccuggucccccaagaauggguucaacacuucuaccaagaaucagcccccgcccaaacccagguggcucugguuagauaugucaacccugacacugguagaguguuguuugaggccaagcugcauaaauuagguuucaugacuauagcuaagaauggugacucuccaauaacuguccccccaaauggauacuuuagguuugaaucuugggugaacccauuuuauacacuugcccccaugggaacugggaaugggcguagaaggguucaauaa

SEQ ID NO: 6812 - RNA, 1647 nt, Artificial Sequence
  VP1__Norovirus_and/or_Norovirus-like__AF539440
augaagauggcgucgaaugacgccacuccaucuaaugauggugccgccggccucgucccagagaucaacaaugaggcaauggcgcuagauccaguggcgggugcagcgauagcagcaccccucacuggucagcagaauauaauugaucccuggauuaugaauaauuuugugcaagcaccugguggugaguuuacaguauccccuaggaauuccccuggugaagugcuucuuaauuuggaauugggcccagaaauaaaucccuauuuggcccaucuugcuagaauguauaaugguuaugcagguggauuugaagugcagguaguccuagcuggaaaugcguuuacagcaggaaagauaaucuuugcagcuauacccccuaauuuuccaauugauaaucuaagcgcagcacagaucacaaugugcccacaugugauuguggaugucagacaguuggaaccggucaaccucccgaugccugacguucgcaacaacuucuuucauuacaaucaagggucugauucgagauugcgcuuaauugcaaugcuguauacaccucuuagggcaaauaauucuggggaugauguuuuuacugugucuuguagagugcugacuaggccuagcccugacuuuucauuuaauuuccuugugccaccuacuguggagucaaagacaaaacccuucacccucccuauucugacuaucucugaaauguccaauucuagguuuccagugccgauugauucucugcacaccagcccaacugagaauauuguuguccagugccaaaaugggcgcgucacucuugauggugaguugaugggcaccacccaacucuuaccuagucaaaucugugcuuucaggggcgugcucaccagaucaacaagcagggccagugaucaggccgacacagcaaccccuagguuguuuaauuauuauuggcacauacaauuggauaaucuaaaugggacuccuuaugauccugcagaagacauaccaggcccccuagggacaccagauuuccggggcaaggucuuuggcguggccagccagagaaaucccgacagcacaacuagagcacaugaagcaaagguggacacaacagcuggucguuucaccccaaaacuaggcucauuagagauauccacugaaucugaugacuuugaucaaaaccaaccaacaagauucaccccaguuggcguugggguugaccaugaggcagacuuucaacaauggucuuuacccgacuauucuggucaguucacccacaacaugaacuuagccccagcuguugcucccaacuucccuggugagcagcuccuuuucuuucgcucacaguuaccauccucuggugggcgauccaacgggauucuagacugccuggucccccaagaauggguucagcacuucuaccaagaaucggcccccgcccaaacucaaguggcccugguuagguaugucaacccugacacugguagaguauuauuugaggccaagcugcacaaauuagguuucaugacuauagcuaagaauggugacucuccaauaacugucccuccaaauggauacuuuagguuugaaucuugggugaacccauuuuauacacuugcccccaugggaacugggaaugggcguagaaggauucaauaa

SEQ ID NO: 6813 - RNA, 1647 nt, Artificial Sequence
  VP1__Norovirus_and/or_Norovirus-like__AF414414
augaagauggcgucgaaugacgcugcuccaucuaaugauggugccgccggccucgucccagagaucaacaaugaggcaauggcgcuagagccaguggcgggugcagcgauagcagcgccccucacuggccagcaaaauauaauugaucccuggauuaugaacaauuuugugcaagcaccugguggugaguuuacagugucaccuaggaauuccccuggugaagugcuucuuaauuuggaauuagguccagaaauaaaucccuauuuagcucaucuugcuagaauguacaaugguuaugcagguggauuugaagugcaagugguccuagcuggaaaugcguuuacagcaggaaagguuaucuuugcagcuauacccccuaauuucccuauugauaaucugagcgcggcacagaucacaaugugcccgcacgugauuguggaugucaggcaguuggaaccaaucaaucucccgaugccugauguccgcaacaauuucuuucauuauaaucaagguucugauucaagauuacguuugauugcaaugcuguauacaccucuuagggcaaacaauucuggagaugauguuuuuacugugucuuguaggguguuaacuaggcccagcccugauuucucauucaauuuucuugucccacccacuguggaaucaaagacaaaacuuuuuacccuccccauuuuaaccaucucugaaauguccaauuccagguuuccaguuccaauugacucucugcacacuagcccaacugagaauauaguuguccagugccaaaaugggcgcgucacucuugacggugaguugaugggcaccacccaacucuuaccgagccaaauaugugcuuucaggggcacacucacuaggucaacaagcagggccagugaccaagccgacacaccaacucccaggcuauucaaccaucgcuggcacauacaauuggauaaucuaaauggaacucccuacgacccugcagaggacauaccagcuccuuugggcacaccagacuuccggggcaaggucuuuggcguggccagccagagaaaccccgacagcacaacaagggcacaugaagcaaaaguggacacaacaucuggccgcuucaccccaaaauuaggcuccuuagaaauaaucacggaaucugacgacuuugacacaaaccagucaacaaaauucaccccaguuggcaucggaguugacaaugagucagaauuucagcaaugguccuuacccaacuauucuggucaauucacucauaauaugaacuuagccccagcuguugcccccaauuuucuuggugaacagcuacuuuucuuccggucacagcugccauccucuggugggcggucuaacgggguucuagacugccuggucccccaggaauggguucaacacuuuuaccaagaaucagcccccgcccaaacgcagguggcccugguuagguaugucaacccugacacugguagagugcuauuugaggccaagcuacacaaauuggguuuuaugacuauagcaaagaauggugacuccccaauaacugucccuccaaauggauacuuuagauuugaaucuuggguuaaccccuuuuauacacuugcccccaugggaacuggaaacgggcguagaaggauucaauaa

SEQ ID NO: 6814 - RNA, 1647 nt, Artificial Sequence
  VP1__Norovirus_and/or_Norovirus-like__AB190457
augaagauggcgucgaaugacgccacuccaucuaaugauggugccgccggccucgucccagagaucaacaaugaggcaauggcgcuagacccaguggcgggugcagcgauagcagcaccccucacuggucagcaaaauauaauugaucccuggauuaugaauaauuuugugcaagcaccugguggugaguuuacaguaucccccaggaauuccccuggugaagugcuucuuaauuuggaauugggcccagaaauaaaccccuauuuggcucaucuugcuagaauguauaaugguuaugcagguggauuugaagugcagguaguccuggcuggaaaugcguuuacagcaggaaagauaaucuuugcagcuauacccccuaauuuuccaauugauaaucugagcgcagcacagaucacaaugugcccgcaugugauuguggaugucagacaguuggaaccggucaaccuuccgaugccugacguucgcaacaauuucuuucauuacaaucaagggucugauucgagauugcgcuuaaucgcaaugcuguauacaccucuuagggcaaauaauucuggggaugauguuuuuacugugucuuguagaguguugacuaggccuagcccugacuuuucauuuaauuuucuugugccaccuacuguggagucaaagacaaagcccuucacccucccuauucuaacuaucucugaaauguccaauucuagguuuccagugccgauugauucucugcacaccagcccaacugagaauauuguuguccagugucaaaaugggcgugucacucuugauggugaguugaugggcaccacccaacucuuaccgagucaaaucugugcuuucaggggcgugcucaccagaucaacaagcagggccagugaucaggccgacacagcaaccccuagguuguuuaauuauuauuggcacauacaauuggauaaucuaaaugggacuccuuaugauccugcagaagacauaccaggcccccuagggacaccagauuuccggggcaaagucuuuggcguggccagccagagaaaccccgacagcacaacuagagcacaugaagcaaagguggacacaacagcuggucguuucaccccaaaauuaggcucauuagaaauauccacugaaucuggugacuuugaccaaaaccaaccaacaagauucaccccaguuggcauugggguugacaaugaggcagacuuucaacaauggucuuuacccgacuauucuggucaguucacccacaacaugaacuuggccccagcuguugcucccaacuuuccuggugagcagcuccuuuucuuucgcucacaguuaccaucuucuggugggcgaucuaacgggauucuagacugccuggucccccaagaauggguucagcacuucuaccaagaaucggcccccgcccaaacacaaguggcccugguuagguaugucaacccugacacugguagaguguuauuugaggccaagcugcacaaauuagguuucaugacuauagcuaagaauggugauucuccaauaacugucccuccaaauggauacuuuagguuugaaucuugggugaaccccuuuuauacacuugcccccaugggaacugggaaugggcgcagaaggauucaauaa

SEQ ID NO: 6815 - RNA, 1647 nt, Artificial Sequence
  VP1__Norovirus_and/or_Norovirus-like__AF425768
augaagauggcgucgaaugacgccacuccaucuaaugauggugccgccggccucgucccagagaucaacaaugaggcaauggcgcuagauccaguggcgggugcagcgauagcagcaccccucacuggucagcagaauauaauugaucccuggauuaugaauaauuuugugcaagcaccugguggugaguuuacaguauccccuaggaauuccccuggugaagugcuucuuaauuuggaauugggcccagaaauaaaucccuauuuggcccaucuugcuagaauguauaaugguuaugcagguggauuugaagugcagguaguccuagcuggaaaugcguuuacagcaggaaagauaaucuuugcagcuauacccccuaauuuuccaauugauaaucuaagcgcagcacagaucacaaugugcccacaugugauuguggaugucagacaguuggaaccggucaaccucccgaugccugacguucgcaacaacuucuuucauuacaaucaagggucugauucgagauugcgcuuaauugcaaugcuguauacaccucuuagggcaaauaauucuggggaugauguuuuuacugugucuuguagagugcugacuaggccuagcccugacuuuucauuuaauuuccuugugccaccuacuguggagucaaagacaaaacccuucacccucccuauucugacuaucucugaaauguccaauucuagguuuccagugccgauugauucucugcacaccagcccaacugagaauauuguuguccagugccaaaaugggcgcgucacucuugauggugaguugaugggcaccacccaacucuuaccuagucaaaucugugcuuucaggggcgugcucaccagaucaacaagcagggccagugaucaggccgacacagcaaccccuagguuguuuaauuauuauuggcacauacaauuggauaaucuaagugggacuccuuaugauccugcagaagacauaccaggcccccuagggacaccagauuuccggggcaaggucuuuggcguggccagccagagaaaucccgacagcacaacuagagcacaugaagcaaagguggacacaacagcuggucguuucaccccaaaacuaggcucauuagagauauccacugaaucagaugacuuugaucaaaaccaaccaacaagauucaccccaguuggcguugggguugaccaugaggcagacuuucaacaauggucuuuacccgacuauucuggucaguucacccacaacaugaacuuagccccagcuguugcucccaacuucccuggugagcagcuccuuuucuuucgcucacaguuaccauccucuggugggcgauccaacgggauucuagacugccuggucccccaagaauggguucagcacuucuaccaagaaucggcccccgcccaaacucaaguggcccugguuagguaugucaacccugacacugguagaguauuauuugaggccaagcugcacaaauuagguuucaugacuauagcuaagaauggugacucuccaauaacugucccuccaaauggauacuuuagguuugaaucuugggugaacccauuuuauacacuugcccccaugggaacugggaaugggcguagaaggauucaauaa

SEQ ID NO: 6816 - RNA, 1647 nt, Artificial Sequence
  VP1__Norovirus_and/or_Norovirus-like__AF414415
augaagauggcgucgaaugacgcugcuccaucuaaugauggugcugccggccucgucccagagaucaacaaugaggcaauggcgcuagagccaguggcgggugcagcgauagcggcaccccucacuggccagcaaaauauaauugaucccuggauuaugaauaauuuugugcaagcaccugguggugaguuuacagugucaccuaggaauuccccuggugaagugcuucuuaauuuggaauuagguccagaaauaaaucccuauuuggcucaucuugcuagaauguacaaugguuaugcagguggauuugaagugcaagcgguccuagcuggaaaugcguuuacagcaggaaagguuaucuuugcagcuauacccccuaauuucccuauugacaaucugagugcggcacagaucacaaugugcccgcacgugauuguggaugucaggcaguuggaaccaaucaaucucccgaugccugauguccgcaacaauuucuuucauuauaaucaagguucugacucaagauuacguuugauugcaauguuguauacaccucuuagggcaaacaauucuggagaugauguuuuuacugugucuuguaggguguuaacuaggcccagcccugauuucucauucaauuuucuugucccacccacuguggaaucaaagacaaaacuuuuuacccuccccauuuuaaccaucucugaaauguccaauuccagguuuccaguuccaauugacucucugcacaccagcccaacugagaauauaguuguccagugccaaaaugggcgcgucacucuugacggugaguuaaugggcaccacccaacucuuaccgagccaaauaugugcuuucaggggcacacucacuaggucaacaagcagggccagugaccaagccgacacaccaacccccaggcuauucaaccaucguuggcacauacaauuggauaaucuaaauggaacucccuacgacccugcagaggacauaccagcuccuuugggcacaccagacuuccggggcaaggucuuuggcguggccagccagagaaaccccgacagcacaacaagggcacaugaagcaaaaguggacacaacaucugaccgcuucaccccaaaauugggcuccuuagaaauaaucacugaaucuggugacuuugacacaaaccagucaacaaaauucaccccaguuggcaucggaguugacaaugaggcagaauuucagcaaugguccuuacccaacuauucuggucaauuuacucauaauaugaacuuagccccagcuguugcccccaauuuuccuggagaacagcuacuuuucuuccggucacagcugccauccucuggugggcggucuaacgggguucuagacugccuggucccccaggaauggguucaacacuuuuaccaagaaucagcccccgcccaaacgcagguggcccugguuagguaugucaacccugacacuggcagagugcuauuugaggccaagcuacacaaauuggguuuuaugacuauagcaaagaauggugacuccccaauaacugucccuccaaauggauacuuuagauuugaaucuuggguuaaccccuuuuauacacuugcccccaugggaacuggaaacgggcguagaaggauucaauaa

SEQ ID NO: 6817 - RNA, 1647 nt, Artificial Sequence
  VP1__Norovirus_and/or_Norovirus-like__KT779557
augaagauggcgucgaaugacgcugcuccaucuaaugauggugccgccggccucguaccagagaucaauaaugaggcaauggcgcuagauccaguggcgggcgcagcgauagcagcaccccuuacuggucagcaaaacauaauagaucccuggauuaugaauaauuuugugcaagcaccugguggugaguuuacagugucaccuaggaacuccccuggugaaguacuucuaaauuuagaauuaggcccagaaauaaaccccuaccuggcgcaucuugcuaggauguacaaugguuaugcagguggguuugaggugcaggugguccuggcuggaaaugcguuuacagcagggaaagugaucuuugcagcuauaccccccaauuucccaacugacaauuugagugcagcgcagauuacaauguguccucauguaauuguagaugucaggcaguuggaaccaaucaaccucccgaugccugacguccgcaacaauuucuuccauuauaaucaagguucugauucgagguuacgcuuaauugcaauguuguauacuccccuuagggcaaauaauucuggagaugauguuuucacugugucauguaggguguugacuaggcccaguccugacuucucauucaauuuccucgucccgcccacuguggaaucaaagauaaaaccuuucacccucccuauuuugaccaucucugagaugucuaauucuagauuuccagugccaauugacucucugcacaccaguccaacugauaacauuguuguccagugccaaaaugggcgcgucacccuugauggcgagcuaaugggcaccacccaacucuugccgagucagauaugugcuuuuaggggugugcucaccagaucaacaagcagggccagugaucaagcugacgcagcaaccccuagacucuucaacuaccauuggcacauacaacuagacaaccuaaaugggaccccguaugacccugcagaggacauaccagcuccucuggggacgccagacuuucggggcaaagucuuuggcguagccagccagagaaacccugacagcacaacaagggcacaugaggcaaaaguggauacaacaucuggccgcuucaccccaaaauugggcucccuagaaauauccacugaaucuggugacuuugaccagaaucaaccaauaagauucaccccaguuggcauuggaguugacaaugaggcagacuuucaacaauggaccuuaccugauuauuccggucaguucacccacaacacgaaucuggccccagcugucgcucccaauuuucccggugaacagcuucuuuucuuccgcucacaguugccauccucuggcgggcgguccaauggcauucuagacugccuggucccccaggaauggguccaacacuucuaccaggaauccgccccugcccaaacgcagguggcucuggucagguaugucaacccugauacugguaggguguuauuugaggcuaagcugcauaagcuaggcuacaugaccauagcuaagaguggugauucuccaauaacuguacccccaaauggauacuuuagguuugaaucuugggugaaucccuuuuacacauuagcccccaugggaacugggaaugggcguagaaggauucaauaa

SEQ ID NO: 6818 - RNA, 1647 nt, Artificial Sequence
  VP1__Norovirus_and/or_Norovirus-like__AY247432
augaagauggcgucgaaugacgccacuccaucuaaugauggugccgccggccucgucccagagaucaacaaugaggcaauggcgcuagacccaguagcgggugcagcgauagcagcaccccucacuggucagcaaaacauaauugaucccuggauuaugaauaauuuugugcaagcaccugguggugaguuuacaguauccccuaggaauuccccuggugaagugcuucuuaauuuggaauugggcccagaaauaaaucccuauuuggcccaucuugcuagaauguauaaugguuaugcagguggauuugaagugcagguaguccuggcuggaaaugcguuuacagcaggaaagauaaucuuugcagcuauacccccuaauuuuccaauugauaaucugagcgcggcacagaucacaaugugcccgcaugugauuguggaugucagacaguuggaaccagucaaccucccgaugccugacguucgcaacaacuucuuccauuauaaucaagggucugauucaagauugcgccuaauugcaaugcuguauacaccucuuagggcaaauaauucuggggaugauguuuuuacugugucuuguagaguguugacuaggccuagcccugacuuuucauuuaauuuccuugugccaccuacuguggagucaaagacaaaacccuuuacucucccuauucuaacuaucucugaaauguccaauucuagguuuccagugccgauugauucucugcacaccagcccaaaugguaauuuuguuguccagugccagaaugggcgcgucacucuugauggcgaguugauggguaccacccaacucuugccgagucaaaucugugcuuuuaggggcgugcucaccagacaaguaagcagggccggugaucagaucgacacagcaaccccuaggucguuuggcaaucauuggcauauacaauuggauaauuuaaaugggacuccuuaugauccugcagaagacauaccaggcccccuagggacaccagacuuccagggcauagucuuuggcguggccagccagagaaacuccgauggcacaacuagagcacaugaagcaaagguggacacaagaacuggccgcuucaccccaaaauuaggcucauuaguaauauccacugauucugaagacuuucaacaaaacaaaccaacaagauucaccccaguuggcguugggguugacagugaggaagaauuugaucaauggucccuacccgacuauucugguccuaucacccacaacaugaaccuggccccagcuguugcucccaacuucccuggugagcagcuccuuuucuuccgcucgcaguuaccaucuucuggugggauauccaaggggauccuggacugccuggucccccaagaauggguccagcacuucuaccaagaaucagcccccgcccaaacacaaguggcccugguuagguaugucaacccugauacugguagaguacuauuugaggccaaguugcacaaauuagguuucaugacuauagcuaaggauggugauucuccaauaacugucccuccaaauggauacuuuagguuugaaucuugggugaaccccuuuuauacacuugcccccaugggaacugggaaugggcguagaaggauucaauaa

SEQ ID NO: 6819 - RNA, 1647 nt, Artificial Sequence
  VP1__Norovirus_and/or_Norovirus-like__AF414411
augaagauggcgucgaaugacgcugcuccaucuaaugauggugccgccggccucgucccagagaucaacaaugaggcaauggcgcuagagccaguggcgggugcagcgauagcagcgccccucacuggccagcaaaauauaauugaucccuggauuaugaauaauuuugugcaagcaccugguggugaguuuacagugucaccuaggaauuccccuggugaagugcuccuuaauuuggaauuaggucuagaaauaaaucccuauuuggcucaucuugcuagaauguacaaugguuaugcagguguauuugaagugcaagugguccuugcuggaaaugcguuuacagcaggaaagguuaucuucgcagcuauacccccuaauuucccuauugacaaucugagcgcggcgcagaucacaauguguccgcacgugauuguggaugucaggcaguuggaaccaaucaaucucccgaugccugauguccgcaacaauuucuuucauuauaaucaagguucugauucaagauuacguuugauugcaauguuguauacaccucuuagggcaaauaauucuggagaugauguuuuuacugugucuuguaggguguuaacuaggcccagcccugauuucucauucaauuuucuugucccacccacuguggaaucaaagacaaaacuuuuuacccuccccauuuuaaccaucucugaaauguccaauuccagguuuccaguuccaauugacucucugcacaccagcccaacuaagaauauaguuguccagugccaaaaugggcgcgucacucuugacggugaguuaaugggcaccacccaacucuuaccgagccaaauaugugcuuucaggggcacacucacuagaucaacaagcagggccagugaccaagccgacacaccaaccccuaggcuauucggccaccguuggcacauacaauuggauaaucuaaauggaacucccuacgacccugcagaggacauaccagcuccuuugggcacaccagacuuccggggcaaggucuuugguguggccagccagagaaaccccgacagcacaacaagggcacaugaagcaaaaguggacacgacaucuggccgcuucaccccaaaauugggcuccuuagaaauaaucacugaaucugaugacuuugacacaaaccagucaacaaaauucaccccaguuggcaucggaguugacaaugaggcagaauuucagcaaugguccuugcccaacuauucuggucaguuuacucauaauaugaacuuagccccagcuguagcccccaauuuuccuggcgaacagcuacuuuucuuccgaucacagcugccauccucuggugggcggucuaacgggguucuagacugccuggucccccaggaauggguucaacacuuuuaccaagaaucagcccccgcccaaacgcagguggcccugguuagguaugucaacccugacacuggcagagugcuauuugaggccaagcuacacaaauuggguuuuaugacuauagcaaagaauggugacuccccaauaacugucccuccaaauggauauuuuagauuugaaucuugggucaaccccuuuuacacacuugcccccaugggaacuggaaacgggcguagaaggauucaauaa

SEQ ID NO: 6820 - RNA, 1647 nt, Artificial Sequence
  VP1__Norovirus_and/or_Norovirus-like__AJ277617
augaagauggcgucgaaugacgcugcuccaucuaaugauggugccgccggccucgucccagagaucaacaaugaggcaauggcgcuagagccaguggcgggugcagcgauagcagcgccccucacuggccagcaaaauauaauugaucccuggauuaugaauaauuuugcgcaagcaccugguggugaguuuacagugucaccuaggaacuccccuggugaagugcuucuuaauuuggaauuagguccagaaauaaaucccuauuuggcucaucuugcuagaauguacaaugguuaugcagguggauuugaagugcaagugguccuagcuggaaaugcguuuacagcaggaaagguuaucuuugcagcuauacccccuaauuucccuauugacaaucugagcgcggcacagaucacuaugugcccgcacgugauuguggacgucaggcaguuggaaccaaucaaucucccgaugccugauguccgcaacaauuucuuucauuauaaucaagguucugauucaagauuacguuugauugcaauguuguauacaccucuuagggcaaauaauucuggagaugaaguuuucacugugucuuguaggguguuaacuaggcccagcccugauuucucauucaauuuucuugucccacccacuguggaaucaaagacaaaacuuuuuacccuccccauuuuaaccaucucugaaauguccaauuccagguuuccaguuccaauugacucucugcacaccagcccaacugagaauauaguuguccagugccaaaaugggcgcgucacucuugauggugaguuaaugggcaccacccaacucuuaccgagccaaauaugugcuuucaggggcacacucacuagaucaacaagcagggccagugaccaagccgacacaccaacccccaggcuauucaaccaucguuggcacauacaauuggauaaucuaaauggaacucccuacgacccugcagaggacauaccagcuccuuugggcacaccagacuuccgggguaaggucuuuggcguggccagccagagaaaccccgacagcacaacaagggcacaugaagcaaaagcggacacaacaucuggccgcuucaccccaaaauugggcuccuuagaaauaaucacugaaucugaugacuuugacacaaaccagucaacaaaauucaccccaguuggcaucggaguugacaaugaggcagaauuucagcaaugguccuuacccaacuauucuggucaguuuacucauaauaugaacuuagccccagcugucgcucccaauuuuccuggugaacagcuacuuuucuuccgaucacagcugccaucuucuggugggcggucuaacgggguucuagacugccugaucccccaggaauggguucaacacuuuuaccaagaaucagcccccgcccaaacgcagguggcccugguuagguaugucaacccugacacuggcagagugcuauuugaggccaagcuacacaaauuggguuuuaugacuauagcaaagaauggugacuccccaauaacugucccuccaaauggauaccuuagauuugaaucuuggguuaaccccuuuuacacacuugcccccaugggaacuggaaacgggcguagaaggauucaauaa

SEQ ID NO: 6821 - RNA, 1647 nt, Artificial Sequence
  VP1__Norovirus_and/or_Norovirus-like__LC036561
augaagauggcgucgaaugacgccacuccaucuaaugauggugccgccggccucgucccagagaucaacaaugaggcaauggcgcuagauccaguggcgggugcagcgauagcagcaccccucacuggccagcaaaauauaauugaucccuggauuaugaauaauuuugugcaagcaccugguggugaguucacagugucgccuaggaauuccccuggugaagugcuccucaauuuggaauugggcccagagauaaaccccuaucuggcccaucuugcuagaauguacaaugguuaugcagguggguuugaagugcagguaguccuagcuggaaaugcguuuacagcaggaaagauaaucuuugcagcuauacccccuaacuucccaauugacaaucuaagugcagcacagaucacaaugugcccacaugugauuguggaugucaggcaauuggaaccggucaaccucccgaugccugacguucgcaauaacuucuuccacuacaaccaagggucugauucgagauugcgcuugauugcaaugcuguauacaccucuuagggcaaauaacucuggggaugacgucuucacugugucuuguagagugcugacuaggccuagcccugaauuuucauuuaacuuccuugugccacccacuguggagucaaagacaaaacccuucacccucccaauucugacuaucucugaaaugucuaauucuagguuuccagugccgauugauucucugcacaccagcccaacugagaauauugucguccagugccaaaauggacgcgucacucuugauggugaguugaugggcaccacucagcucuuaccuagucaaaucugugcuuucaggggcgugcucacuagaucaacaagcagggcuagugaucaggccgacacagcaaccccuagauuguuuaauuauuauuggcacauacaauuggauaaucuaaaugggacuccuuaugauccugcagaagacauaccaggcccccuggggacaccagauuuccggggcaaagucuuuggcguggccagccaaagaaaccccgacaguacaacuagagcacaugaagcaaagguggacacaacaucuggucgcuucaccccaaaacuaggcucauuagagauauccacugaaucuggugacuuugaccaaaaccaaccaacaagauucaccccaguuggcauuggaguugaucacgaggcagacuuccaacaaugguccuuacccgacuacucuggccaguucacucacaacaugaacuuagccccagcuguugcucccaacuucccuggugagcagcuccuuuucuuccgcucacaguuaccaucuucuggugggcgauccaaugggauucuagacugccuggucccccaagaauggguucagcacuucuaccaagaaucagcccccgcccaaacccagguggcucugguuagauaugucaauccugacacugguagaguguuguuugaggccaagcugcauaaauuagguuucaugacuauagcuaagaauggugacucuccaauaacuguccccccaaauggauacuuuagguuugaaucuugggugaacccauuuuauacacuugcccccaugggaacugggaaugggcguagaaggguucaauaa

SEQ ID NO: 6822 - RNA, 1647 nt, Artificial Sequence
  VP1__Norovirus_and/or_Norovirus-like__KT732274
augaagauggcgucgaaugacgccaccccaucuaaugauggugccgccggccucgucccagagaucaacaaugaggcaauggcgcuagauccaguggcgggugcagcgauagcagcaccccucacuggccagcaaaauauaauugaucccuggauuaugaauaauuuugugcaagcaccugguggugaguucacagugucuccuaggaauuccccuggugaagugcuccucaauuuggaauugggcccagagauaaaccccuaucuggcccaucuugcuagaauguauaaugguuaugcagguggguuugaagugcagguaguccuagcuggaaaugcguuuacagcaggaaagauaaucuuugcagcuauacccccuaacuucccaauugauaaucuaagugcagcacagaucacaaugugcccacaugugauuguggaugucaggcaguuggaaccggucaaccucccgaugccugacguucgcaauaacuucuuccacuacaaccaagggucugauucgagauugcgcuugguugcaaugcuguacacaccucuuagggcaaauaacucuggggaugauguuuucacugugucuuguagagugcugacuagaccuagcccugaauuuucauuuaacuuccuugugccaccuacuguggagucaaagacaaaacucuucacccucccaauucugacuaucucugaaaugucuaauucuagguuuccagugccgauugauucucugcacaccagcccaacugagaacauuguuguccaaugccaaaauggacgcgucacucuugauggugaguugaugggcaccacucagcucuuaccuagucaaaucugugcuuucaggggcgugcucacuagaucaacaagcagggcuagugaccaggccgacacagcaaccccuagauuguuuaauuauuauuggcacauacaauuggauaaucuaaaugggacuccuuaugauccugcagaagacauaccagguccccuggggacaccagauuuccggggcaaagucuuuggcguggccagccaaagaaaccccgacaguacaacuagagcacaugaagcgaagguggacacaacaucuggucgcuucaccccaaaacuaggcucauuagagauauccacugaaucuggugacuuugaccaaaaccaaccaacaagauucaccccaguuggcauugggguugacagcgaggcagacuuccaacaaugguccuuacccgacuacucuggccaguucacucacaacaugaacuuagccccagcuguugcucccaacuucccuggugagcagcuccuuuucuuccgcucacaguuaccaucuucuggugggcgauccaaugggauucuagacugccuggucccccaagaauggguucagcacuuuuaccaagaaucagcccccgcccaaacccagguggcucugguuagauaugucaacccugacacugguagaguguuguuugaggccaagcugcacaaauuagguuucaugacuauagcuaagaauggugacucuccaauaacuguccccccaaauggauacuuuagguuugaaucuugggugaacccauuuuauacacuugcccccaugggaacugggaaugggcguagaagaguucaauaa

SEQ ID NO: 6823 - RNA, 1647 nt, Artificial Sequence
  VP1__Norovirus_and/or_Norovirus-like__AY247439
augaagauggcgucgaaugacgccgcuccaucuaaugauggugccgccggccucgucccagagaucaacaaugaggcaauggcgcuagacccaguggcgggugcagcgauagcagcaccccucacuggucagcaaaacauaauugaucccuggauuaugaauaauuuugugcaagcaccugguggugaguuuacuguauccccuaggaauuccccuggugaagugcuucuuaauuuggaauugggcccagaaauaaaucccuauuuggcccaucuugcuagaauguauaaugguuaugcagguggauuugaagugcagguaguccuggcugggaaugcguuuacagcaggaaagauaaucuuugcagcuauacccccuaauuuuccaauugauaaucugagcgcggcacagaucacaaugugcccgcaugugauuguggaugucagacaguuggaaccagucaaccucccgaugccugacguucgcaacaacuucuuccauuauaaucaagggucugauucaagauugcgccuaaucgcaaugcuguauacaccucuuagggcaaauaauucuggggaugauguuuuuacugugucuuguagaguguugacuaggccuagcccugacuucucauuuaauuuccuagugccaccuacuguggagucaaagacaaaacccuucacucucccuauccuaacuaucucugaaauguccaauucuagguuuccagugccgauugauucucugcacaccagcccaaauaauaauuuuguuguccagugccaaaaugggcgcgucacucuugauggcgaguugauggguaccacccaacucuugccgagucaaaucugugcuuuuaggggcgugcucgccagacaaauaaacagggccggugaucagaucgacacaacaaccccuaggucauuugaccaucauuggcauauacaauuggauaaucuaaaugggacuccuuaugauccugcagaagacauaccaggcccccuagggacaccaggcuucaagggcauagucuuugguguggccagccagagaaacuccgauggcacaacuagagcacaugaagcaaagguggacacaagaacuggccgcuucaccccaaaauuaggcucauuaguaauauccacugauucugaagacucucaacaaaacaaaccaacaagguucaccccaguuggcguugggguugacaaugaggaagaauuugaucaauggucucuacccaacuauucugguccuaucacccacaacaugaaccuggccccagcuguugcucccaacuucccuggugagcagcuccuuuucuuccgcucgcaguuaccaucuucuggugggacauccaaggggauccuggacugccuggucccccaagaauggguccagcacuucuaccaagaaucagcccccgcccaaacacaaguggcccugguuagguaugucaacccugauacugguagaguacuauuugaggccaaguugcacaaauuagguuucaugacuauagcuaaagauggugauucuccaauaacugucccuccaaauggauacuuuagguuugaaucuugggugaaccccuuuuauacacuugcccccaugggaacugggaaugggcguagaaggauucaauaa

SEQ ID NO: 6824 - RNA, 1647 nt, Artificial Sequence
  VP1__Norovirus_and/or_Norovirus-like__AF539439
augaagauggcgucgagugacgccaccccaucuaacgauggugccgccggccucgucccagagaucaacaaugaggcaauggcgcuagauccgguggcgggugcagcgauagcagcaccccucacuggucagcaaaauauaauugaucccuggauuaugaauaauuuugugcaagcaccugguggugaguuuacaguguccccuaggaauuccccuggugaauugcuucuuaacuuggaauuggguccagaaauaaaccccuauuuagcccaucuugcuagaauguauaaugguuaugcagguggauuugaagugcagguaguccuggcuggaaaugcguuuacagcagggaagauaaucuuugcagcuauacccccuaauuuuccaauugacaaucugagcgcagcacagaucacgauguguccgcaugugauuguggaugucagacaguuggaaccggucaaccuuccgaugccugacguucgcaacaacuucuuucauuacaaucaagggucugauucgagauugcgcuuaauugcaaugcuguauacaccucuuagggcaaauaauucuggggaugauguuuucacugugucuuguagaguguugacuaggccuagcccugacuuuucauuuaauuuccuugugccaccuacuguggagucaaagacaaaacccuucacccucccuauucugacuaucucugaaauguccaauucuagguuuccagugccgauugauucucugcacaccagcccaacugagaacauuguuguccagugccaaaaugggcgcgucacucuugacggugaguugaugggcaccacccaacucuuaccgagucaaaucugugcuuuuaggggcgugcucaccagaucaacaagcagggccagugaucaggccgacacaccaaccccuagguuguuuaauuauuauuggcacauacaauuggacaaccuaaaugggacuccuuaugacccugcagaagacauaccaggcccccuagggacaccagauuuucggggcaaagucuuuggcguggccagccagagaaaucccgacagcacaacuagagcacaugaagcaaagguggacacaacagcuggucguuucaccccaaaauuaggcucauuagagauauccacugaaucuggugacuuugaccaaaaccaaccaacaagauucaccccaguuggcauugggguugaccaugaggcagacuuucaacaauggucuuuacccgacuauucuggucaguucacucacaacaugaacuuggccccagcuguugcucccaacuucccuggugagcagcuccuuuucuuccgcucacaauuaccauccucuggugggcgauccaacgggauucuagacugccuggucccccaagaauggguucagcacuucuaccaagaaucugcccccgcccaaacacaaguggcccugguuagguaugucaacccugacacugguagaguguuauuugaggccaagcugcacaaguuagguuucaugacuauagcuaagaauggugacucuccaauaacugucccuccaaauggauacuuuagguuugaaucuuggguaaaccccuuuuauacacuugcccccaugggaacugggaaugggcguagaaggauucaauaa

SEQ ID NO: 6825 - RNA, 1647 nt, Artificial Sequence
  VP1__Norovirus_and/or_Norovirus-like__AF414413
augaagauggcgucgaaugacgcugcuccaucuaaugauggugccgccggccucgucccagagaucaacaaugaggcaauggcgcuagagccaguggcgggugcagcgauagcagcgccccucacuggccagcaaaauauaauugaucccuggauuaugaauaauuuugugcaagcaccugguggugaguuuacagugucaccuaggaauuccccuggugaagugcuucuuaauuuggaauuagguccagaaauaaaucccuauuuggcucaucuugcuagaauguacaaugguuaugcagguggauuugaagugcaggugguccuagcuggaaaugcguuuacagcaggaaagguuaucuuugcagcuauacccccuaauuucccuauugacaaucugagcgcggcacagaucacaaugugcccgcacgugauuguggaugucaggcaguuggaaccaaucaaucucccgaugccugauguccgcaacaauuucuuucauuauaaucaagguucugauucaagauuacguuugauugcaauguuguauacaccucuuagggcaaauaauucuggagaugguguuuuuacuguaucuuguaggguguuaacuaggcccagcccugauuucucauucaauuuucuugucccacccacuguggaaucaaagacaagacuuuuuacccuccccauuuuaaccaucucugaaauguccaauuccagguuuccaguuccaauugacucucugcacaccagcccaacugagaauauaguuguccagugccaaaaugggcgcgucacucuugacggugaguuaaugggcaccacccaacucuuaccgagccaaauaugugcuuucaggggcacacucacuaggucaacaagcagggccagugaccaagccgacacaccaauccccaggcuauucaaccaccguuggcauauacaauuggauaaucugaauggaacucccuacgacccugcagaggacauaccagcuccuuugggcacgccagacuuccggggcaaggucuuuggcguggccagccagagaaaccccgacagcacaacaagggcacaugaagcaaaaguggacgcaacaccuggucgcuucaccccaaaauugggcuccuuagaaauaaucacugaaucugaugacuuugacacaaaccagucaacaaaauucaccccaguuggcaucggaguugacaaugaggcagaauuucagcaaugguccuuaccuaacuauucuggucaguuuacucacaauaugaacuuagccccagcuguugcccccaauuuuccuggugaacagcuacuuuucuuccggucacagcugccauccucuggugggcguuccaacgggguucuagacugccuggucccccaggaauggguucaacacuuuuaccaagaaucagcccccgcccaaacgcagguggcccugguuagguaugucaacccugacacuggcagagugcuauuugaggccaagcugcacaaauuggguuuuaugacuauagcaaagaauggugacucaccaauaacuguccccccaaauggauacuuuagauuugaaucuuggguuaaccccuuuuauacacuugcccccaugggaacuggaaaugggcguagaaggauucaauaa

SEQ ID NO: 6826 - RNA, 1647 nt, Artificial Sequence
  VP1__Norovirus_and/or_Norovirus-like__AF427112
augaagauggcgucgaaugacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaauuuugugcaagcaccugguggugaguuuacaguauccccuaggaauucuccuggugaagugcuucuuaauuuggaauugggcccagaaauaaaucccuauuuggcccaucuugcuagaauguauaaugguuaugcagguggauuugaagugcagguaguccuagcuggaaaugcguuuacagcaggaaagauaaucuuugcagcuauacccccuaauuuuccaauugauaaucuaagcgcagcacagaucacaaugugcccacaugugauuguggaugucagacaguuggaaccggucaaccucccgaugccugacguucgcaacaacuucuuucauuacaaucaagggucugauucgagauugcgcuuaauugcaaugcuguauacaccucuuagggcaaauaauucuggggaugauguuuuuacugugucuuguagagugcugacuaggccuagcccugacuuuucauuuaauuuccuugugccaccuacuguggagucaaagacaaaacccuucacccuccccauucugacuaucucugaaauguccaauucuagguuuccagugccgauugauucucugcacaccagaccaacugagaauauuguuguccagugccaaaaugggcgcgucacucuugauggugaguugaugggcaccacccaacucuuaccuagucaaaucugugcuuuuaggggcgugcucaccagaucaacaagcagggccagugaucaggccgacacagcaaccccuagguuguuuaauuauuauuggcacauacaauuggauaaucuaaaugggacuccuugugauccugcagaagacauaccaggcccccuagggacaccagauuuccggggcaaagucuuuggcguggccagccagagaaaucccgacagcacaacuggagcacaugaagcaaagguggacacaacagcuggucgcuucaccccaaaacuaggcucauuagagauauccacugaaucuggugacuuugaucaaaaccaaccaacaaaauucaccccagucggcauugggguugaccaugaggcagacuuucaacaauggucuuuacccgacuauucuggucaguucacccacaacaugaacuuagccccagcuguugcucccaacuucccuggugagcagcuccuuuucuuccgcucacaguuaccauccucuggugggcgauccaacgggauucuagacugccuggucccccaagaauggguucagcacuucuaccaagaaucggcccccgcccaaacucaaguagcccugguuagguaugucaacccugacacugguagaguauuauuugaggccaagcugcacaaauuagguuucaugacuauagcuaagaauggugacucuccaauaacugucccuccaaauggauacuuuagguuugaaucuugggugaaccccuuuuauacacuugcccccaugggaacugggaaugggcguagaaggauucaauaa

SEQ ID NO: 6827 - RNA, 1647 nt, Artificial Sequence
  VP1__Norovirus_and/or_Norovirus-like__AF190817
augaagauggcgucgaaugacgccacuccaucuaaugauggugccgccggccucgucccagagaucaacaaugaggcaauggcgcuagacccaguggcgggugcagcgauagcagcaccccucacuggucagcaaaacauaauugaucccuggauuaugaauaauuuugugcaagcaccugguggugaguuuacaguguccccuaggaaucccccuggugaagugcuucuuaauuuggaauugggcccagaaauaaaccccuauuuggcccaucuugcuagaauguauaaugguuaugcagguggauuugaagugcagguaguccuggcugggaaugcguuuacagcaggaaagauaaucuuugcagcuauaccuccuaauuuuccaauugauaaucugagcgcagcacaaaucacaaugugcccgcaugugauuguggaugucagacaguuggaaccggucaaccucccgaugccugacguucgcaacaacuucuuucauuacaaucaagggucugauucgagauugcgcuuaauugcaaugcuguauacaccucuuagggcaaauaauucuggagaugauguuuuuacuguguccuguagaguacugacuaggccuagcccugacuucucauucaauuuccuugucccaccuacuguggaaucaaagacaaaacccuuuacccucccuauucugacuaucucugaaauguccaauucuagguuuccagugccgauugagucuuugcacaccggcccaacugagaauauuguuguccagugccaaaaugggcgcgucacucuugauggugaguugaugggcaccacccaacucuuaccgagucaaauuugugcuuuuaggggcgugcucaccagaucaacaaguagggccagugaucaggccgauacagcaaccccuaggcuguuuaauuauuauuggcauguacaauuggauaaucuaaaugggacaccuuaugacccugcagaagacauaccaggcccccuagggacaccagacuuccggggcaaggucuuuggcguggccagccagagaaacccugacagcacaacuagagcacaugaagcaaagguggacacaacagcuggucguuucaccccaaaauugggcucauuagagauaucuacugacuccagugacuuugaccaaaaccaaccaacaagauucaccccaguuggcauugggguugacaaugaggcagauuuucaacaauggucuuuacccgacuauucuggucaauucacucacaacaugaacuuggccccagcuguugcucccaacuucccuggugagcagcuccuuuucuuccgaucacaguuaccaucuucuggugggcgauccaacgggguucuagacugucuggucccccaggaaugggcucaacacuucuaccaggaaucggccccggcccaaacacaaguggcccugguuagguaugucaacccugacacugguagagugcuauuugaggccaagcugcauaaauuagguuucaugacuauagcuaagaauggugacucuccaauaacuguccccccaaauggauacuuuagguuugaaucuugggugaaccccuuuuauacacuugcccccaugggaacugggaaugggcguagaaggauucaauaa

SEQ ID NO: 6828 - RNA, 1647 nt, Artificial Sequence
  VP1__Norovirus_and/or_Norovirus-like__LC035072
augaagauggcgucgaaugacgccacuccaucuaaugauggugccgccggccucgucccagagaucaacaaugaggcaauggcgcuagauccaguggcgggugcagcgauagcagcaccccucacuggccagcaaaauguaauugaucccuggauuaugaacaauuuugugcaagcaccugguggugaguuuacagugucgccuaggaauuccccuggugaagugcuccucaauuuggaauugggcccagagauaaaccccuaucuggcccaucuugcuagaauguacaaugguuaugcagguggguuugaagugcagguaguccuagcuggaaaugcguuuacagcaggaaagauaaucuuugcagcuauacccccuaacuucccaauugacaaucuaagugcagcacagaucacaaugugcccacaugugauuguggaugucaggcaguuggagccggucaaccucccgaugccugacguucgcaauaacuucuuccacuacaaccaagggucugauucgagauugcgcuugauugcaaugcuguacacaccucuuagggcaaauaacucuggggaugacgucuucacugugucuuguagagugcuaacuaggccuagcccugaauuuucauuuaacuuccuugugccacccacuguggagucaaagacaaaacccuucacccucccaauucugacuaucucugaaaugucuaauucuagguuuccagugccgauugauucucugcacaccagcccaacugagaauauugucguccagugccaaaauggacgcgucacucuugauggugaguugaugggcaccacucagcucuuaccuagucaaaucugugcuuucaggggugugcucacuagaucaacaagcagggcuagugaccaggccgacacagcaaccccuagauuguuuaauuauuauuggcacauacaauuggauaauccaaaugggacuccuuaugacccugcagaagacauaccaggcccccuggggacaccagauuuccggggcaaagucuuuggcguggccagccaaagaaaccccgacaguacaacuagagcacaugaagcaaagguggacacaacaucuggucgcuucacgccaaaacuaggcucauuagagauauccacugaaucugaugacuuugaccaaaaccaaccaacaagauucaccccaguuggcauuggaguugaucgcgaggcagacuuccaacaaugguccuuacccgacuacucuggccaguucacucacaacaugaacuuagccccagcuguugcugccaacuccccuggugagcagcucauuuucuucuggucacagucaccauacuguggugggcgauccaauaggguucuagacugcauggucccccaagaauggguucagcacuuuuaccaagaaucagcccccgcccaaacccagcuggcucugguuagauauguuaacccugacacugguagaguguuguuugaggccaagcugcauaaauuagguuucaugacuauagcuaagaauggugacucuccaauaacuguccccccaaauggauacuuuagguuugaaucuugggugaacccauuuuacacacuugcccccaugggaacugggaaugggcguagaaggguucaauaa

SEQ ID NO: 6829 - RNA, 1647 nt, Artificial Sequence
  VP1__Norovirus_and/or_Norovirus-like__DQ093064
augaagauggcgucgaaugacgccgcuccaucgaaugauggugcugccaaccucguaccagaggccaacaaugagguuauggcacuugaaccggugguaggggccucaaucgcagcuccuguugucggucagcaaaauauaauugaccccuggauuagagaaaauuuuguccaagcaccacagggcgaguuuacuguuucgccaaggaauucgcccggugagaugcuuuuaaaccuugaauugggcccagaacuuaaccccuauuugagucauuugucccgcauguacaacggauaugcugguggcaugcagguucaggugguccuagcugggaaugcguucacagcugggaaaaucaucuuugccgccguaccaccacauuuuccuguggauaauauuagugcagcccagauaacuauguguccccaugugauuguugaugugagacagcuugaaccagugcuucugccccuccccgauauaaggaacagguucuuccauuacaaccaggagaacaccccccggaugagacuuguggccaugcucuacacgccucugagggcuaauucuggugaggacguguucacuguguccuguaggguucugacucgccccgcuccagauuuugaguuuacauucuuaguaccaccaacuguugaaucaaaaacaaaaccuuuuacucuaccuauucuaacucuuggugaguugucuaacucccguuuuccggcugcuauagauaugcuuuacgcugaucccaaugaaucaauaguuguucagccccaaaaugguaggugcacucuugauggcacauugcaaggcacaacacaauugguuccaacacagauuugugcuuuuagaggcacccugaucagccagaccgcgagagcgaccgacucaacagauuccccccagagagcccgugaucauccauuacacguccaggucaagaaccuagacggcacacaguaugacccaacagaugauauaccugcaguccugggggcuauugacuucaaaggcacaguauuuggaguggcuagucagagggaugucucuggaccacaagaacagggccacuaugccacccgagcccaugaagcacacauugauacaacugacccaaaguaugcacccaaauuaggcacaauucuuaucaaaucugaauccaaugauuucaucacaaaucaacccauuagguucacuccaguggguaugggugacaacaauuggagacagugggaauuaccugauuauucuggcagacuaaccuuaaauaugaaccuugcccccgcuguuuccccaucuuucccuggugaacgaauccuuuucuuuaggucuauagugccaucagcuggaggcuacgggucuggcuauauagacugucucauaccccaggaaugggggcaacacuucuaccaggaagcagcaccuucacaauccgcuguugcacugguuagguauguuaaccccgacacugggcguaacaucuuugaggccaaguugcacagagaaggguuccucaccguggccaauucuggaaacaauccuauugugguucccccuaaugguuauuuuagauuugaggcuuggguuaaucaguuuuacacacuugcccccaugggaucuggacaggggcguagaagguaa

SEQ ID NO: 6830 - RNA, 1647 nt, Artificial Sequence
  VP1__Norovirus_and/or_Norovirus-like__L23830
augaagauggcgucgaaugacgcugcuccaucuaaugauggugccgccggccucgucccagagaucaacaaugaggcaauggcgcuagauccaguggcgggugcagcgauagcagcaccccucacuggccagcaaaauauaauugaucccuggauuaugaauaacuuugugcaagcaccugguggugaguuuacagugucaccuaggaauuccccuggugaagugcuucuuaauuuggaauuagguccagaaauaaaucccuauuuggcucaucuugcuagaauguacaaugguuaugcagguggguuugaagugcaagugguccuggcuggaaaugcguuuacagcagcaaaggugaucuuugcagcuauacccccuaacuucccuauugacaaucugagcgcggcacagaucacaaugugcccgcaugugauuguggaugucaggcaguuggaaccaaucaaucuuccgaugccugauguccgcaacaauuucuuucauuauaaucaagggucugauucaagauuacguuuaaucgcaaugcuguauacaccucuuagggcaaauaauucuggagaugauguuuucacugugucuuguaggguguuaacuaggccuagcccugacuucucauuuaauuuucuugucccauccacuauggaaucaaagacaaaaccuuuuacccuccccauuuuaaccaucucugaaaugucuaauuccagguuuccggugccaauugacucucugcacaccagcccaacugagaguaucguuguccagugccaaaaugggcgcgucacucuugacggugaguuaaugggcaccacccaacucuuaccgaaccaaauaugugccuucaggggcacacuuacuagaucaacaaacagggccagugaccaagccgacacagcaacccccaggcuauucaaccaucauuggcacauacaauuggauaaucuaaauggaacccccuacgacccugcagaggacauaccagcuccuuuggguacaccagacuuccggggcaaggucuuuggcguagccggccagagaaaccccgacagcacaacaagggcacaugaagcaaaaguggacacaacaucuggccgcuucaccccaaaauugggcucccuagaaauaaccacugaaucugaugacuuugacccaaaccagucaacaaaauucaccccaguuggcauuggaguugacaaugaggcagauuuucagcaaugguccuuaccugacuauuccggucaguuuacucacaacaugaacuuggccccagcugucgcccccaauuuuccuggugaacagcuucuuuucuuccgaucacagcugccaucuucuggugggcggucuaacgggauucuagacugccuggucccccaggaauggguucaacacuucuaccaggaaucagcccccgcccaaacacagguggcccugguuagauaugucaacccugacacugguagagugcuauuugaggccaagcuacacaaauuggguuuuaugacuauagcaaagaauggugacuccccaauaacugucccuccaaauggguauuuuagauuugaaucuuggguuaaccccuuuuacacacuugcccccaugggaacuggaaacgggcguagaaggauucaauaa

SEQ ID NO: 6831 - RNA, 1647 nt, Artificial Sequence
  VP1__Norovirus_and/or_Norovirus-like__KX907728
augaagauggcgucgaaugacgcuccuccaucaucugauggagccgguaaccucguuccagagagucaucaagagguuuuaccgcuugcucccgucgcgggugcugaacuagcagcgccugugguugggcaaacuaauauaauugaccccuggauuaaagaaaacuuuguucaagcuccccaaggugaauuuacuguuucuccaaagaaugccccuggugaaauuuuggucaaccuggaacuugggccaaauuugaauccuuaccuagaacauuugucuagaauguacaaugcuuaugcuggugggauagagguugagauuauccuugcaggcaaugccuucaccgcuggaaagauucuaauugcggcaguccccccaaauuucccaguugagagugugucagcaucacaagccacccaauucccucaugcaauuguggauguuaggacacuugaacccguucggcucccucucccagaugugcgaucuaauuucuuccacuauacuaccaaggaugaacccaagaugagauuagugauuuggcuguauaccccuuugagaacaaaugguagcggagacgacucuuucaccgucucugggagauugcugacccgcccgucaauggacuuccaauuuucuuuucugguccccccuacaguggaaaccaaaacuguucuguucacagucccuggucucaccccccaggagaugagcaacucaagauggcccgcccagauaucugguaugguggugcgcgguaaugagccacaagugguucaguuccagaauggucgcugccauaccgauggcacgcuauuggggaccaccacugugagugaacagugcaucgcuggcuuuguuggcaccucaacgaacacuaggucagccacugguuccacuacagagacuaggacaggugauacagaucuguggcugcggcuugaagagccgaaugggcaacccuaugacaucuuuggagaccaaccugccccucuaggaacacccgauuuccgggcagugauaguaggguuugcaucuagaccacagacacagggaucauauaugaaugaagccuaugucaacacuguggacucccacuucgccccagccacagggaauaccaagaucauccugagaaggggcggaacaggacacgugggaggaggacaucucuggaaauucagaccuuuuggaguggagggaggcgaaggcagagucaguuaccaggaauauguauugcccaacuauucaggagccacugccuccaaucauaaccucgccccucccguugccccaagaaugccuggugaguuacugcuccuguuugaguccgauaugccggugugggacgauggacauggagcugcaccggcucagaagauucacugcuuauugccacaacaauuuaucacccauuucuuugauagccaggcaccagcacuggcggaggccgcacuccuccgguacgugcaucccgauaguagccgagucuuguuugagacaaagcucuauagggagggcuucaugguggugucggccccaacugguagguuugauuuuccccuugauggcuauuuuagguuugauuccuggguuaauucuuucuaugugcuuucccccgugggaaguggccaaggccgccgguaa

SEQ ID NO: 6832 - RNA, 1644 nt, Artificial Sequence
  VP1__Norovirus_and/or_Norovirus-like__AB039779
augaagauggcgucgaaugacgcugcuccaucgaaugauggugcugccaaccucguaccagaggccaacaaugagguuauggcacuugaaccgguggugggagccucaauugcagcuccugucgucggucaacaaaauauaauugaccccuggauuagagaaaauuuuguucaggcaccacagggugaguuuacuguuucaccaagaaacucgccuggugagaugcuuuuaaaucuugaauuaggcccagagcucaauccuuaccugagucauuuaucccgcauguauaaugguuaugcugguggcaugcagguucaggugguccuagcugggaacgcguucacagcugguaaaaucaucuuugccgccguuccaccacauuucccuguagagaauauuagugcagcucaaaucacaaugugcccccaugugauuguugaugugagacaacuugagccugugcuuuugccccucccugacauaaggaauagauucuuucacuacaaccaggaagacaccccccggaugagacuuguggccauguuguauacaccccuuagagcaaacucuggugaggacguguucacagugucuugcagggucuugacccgcccagccccugacuuugaguucacguucuuagugccaccaaccguagaaucaaagacuaagccuuucacacucccuauuuuaacccugggggaacuauccaauuccagauuuccugcuccaauagacaugcuguacacagaucccaaugagacaauugugguacaaccacaaaauggcagaugcacccuagaugggacacuccaagggaccacccagcuggugccuacccaaauuugcucuuuuaggggcacguuaauuagccaaacgccgaggucugcagauucaacagauucagcuccacgggugaggaaccacccccuccacguucagcugaagaaccucgacgggacaccauaugacccaacagaugagguaccggcaguccugggugccauagauuucaaaggaacuguguuuggaguugcuagccagagaaacaccacagggagcucuguaggggcgacccgugcccaugaggugcacauagacaccacaaacccuagauacaccccaaaacuugguucuguguugauguauucugagucuagugauuuugaugauggacaaccaacucgcuuuacccccauuggcaugggagcagaugauuggcaccaaugggaauugcccgaauauuccggucaccucacucuuaacaugaaccuagcccccgcaguugccccugcuuuccccggugagcgcauucucuucuucaggucagugguuccaucugcuggugguuacggaucaggucaaauagacugccucaucccacaggaguggguucagcacuucuaccaggaggccgccccaucacaaucugcgguggcucuuauuagauauguuaacccugacacugggagaaacaucuuugaggcaaagcuacauagagaaggguucaucacuguggcaaauucuggaaacaaccccauaguugugcccccaaaugguuauuucagguuugaggccugggucaaucaauucuaugcacucacccccaugggaacuggacaggggcguaggagaguccaauaa

SEQ ID NO: 6833 - RNA, 1644 nt, Artificial Sequence
  VP1__Norovirus_and/or_Norovirus-like__AB039778
augaagauggcgucgaaugacgcugcuccaucgaaugauggugcugccaaccucguaccagaggccaacaaugagguuauggcacuugaaccgguggugggagccucaauugcagcuccugucgucggucaacaaaauauaauugaccccuggauuagagaaaauuuuguucaggcaccacagggugaguuuacuguuucaccaagaaacucgccuggugagaugcuuuuaaaucuugaauuaggcccagagcucaauccuuaccugagucauuuaucccgcauguauaaugguuaugcugguggcaugcagguucaggugguccuagcugggaacgcguucacagcugguaaaaucaucuuugccgccguuccaccacauuucccuguagagaauauuagugcagcucaaaucacaaugugcccccaugugauuguugaugugagacaacuugagccugugcuuuugccccucccugacauaaggaauagauucuuucacuacaaccaggaagacaccccccggaugagacuuguggccauguuguauacaccccuuagagcaaacucuggugaggacguguucacagugucuugcagggucuugacccgcccagccccugacuuugaguucacguucuuagugccaccaaccguagaaucaaagacuaagccuuucacacucccuauuuuaacccugggggaacuauccaauuccagauuuccugcuccaauagacaugcuguacacagaucccaaugagacaauugugguacaaccacaaaauggcagaugcacccuagaugggacacuccaagggaccacccagcuggugccuacccaaauuugcucuuuuaggggcacguuaauuagccaaacgucgaggucugcagauucaacagauucagcuccacgggugaggaaccacccccuccacguucagcugaagaaccucgacgggacaccauaugacccaacagaugagguaccggcaguccugggugccauagauuucaaaggaacuguguuuggaguugcuagccagagaaacaccacagggagcucuguaggggcgacccgugcccaugaggugcacauagacaccacaaacccuagauacaccccaaaacuugguucuguguugauguauucugagucuagugauuuugaugauggacaaccaacucgcuuuacccccauuggcaugggagcagaugauuggcaccaaugggaauugcccgaauauuccggucaccucacucuuaacaugaaccuagcccccgcaguugccccugcuuuccccggugagcgcauucucuucuucaggucagugguuccaucugcuggugguuacggaucaggucaaauagacugccucaucccacaggaguggguucagcacuucuaccaggaggccgccccaucacaaucugcgguggcucuuauuagauauguuaacccugacacugggagaaacaucuuugaggcaaagcuacauagagaaggguucaucacuguggcaaauucuggaaacaaccccauaguugugcccccaaaugguuauuucagguuugaggccugggucaaucaauucuauacacucacccccaugggaacuggacaggggcguaggagaguccaauaa

SEQ ID NO: 6834 - RNA, 1644 nt, Artificial Sequence
  VP1__Norovirus_and/or_Norovirus-like__KY424345
augaagauggcgucgaaugacgcugcuccaucgaaugauggugcugccaaccucguaccagaggccaacaaugagguuauggcacuugaaccgguggugggagcuucaaucgcagcuccuguugucggucagcaaaauauaauugaccccuggauuagagaaaauuuuguccaagcaccacagggcgaguucacuguuucaccaaggaacucgccuggugagaugcucuuaaaccuugaguugggcccagagcuuaaccccuaucuaagucauuugucccgcauguauaacggguaugcugguggcaugcagguucaggugguccuggcugggaaugcguucacagcugggaaaaucaucuuugccgccguaccaccacauuuccccguagaaaauaucagugcagcccagauaacuaugugcccccauguaauuguugaugugagacaacuugaaccagugcuucugccccucccugacauaaggaacagauucuuccauuacaaucaggagaacaccccccggaugagacuuguagcuaugcuuuacacaccucugagagccaacucuggugaggauguguuuacuguaucuugcaggguuuugacucguccugcuccagauuuugaguucacuuucuuggugccaccaacuguugaaucaaagacuaagccuuuuacacugccuauauuaacucuuggugaauuguccaauucuagguucccagccccaauagauauguuauacacugacccaaaugaggggauuguaguccaaccacaaaaugguaggugcacucuugauggcacucugcaggguaccacacaauuaguccccacccagauaugugcuuucaggggcacgcuaauuggccaaaccucaagaucuucagacucaacugauucagcuccccgaagaagggaucacccacuccacgugcaauuaaagaaucuugauggcacgcaguaugacccaacugaugaggugccagcgguccuuggugccauugauuucaagggggccgucuuuggaguagccagccagagggauguuucagggacucaagugggggcaacucgugcucaugaagugcacaucaacacaacagaucccagguauacaccaaaacugggauccauucucaugcacucggagucggacgacuuugugacugggcagccaauccaauucacacccgugggaaugggugauaacgacuggcaccagugggaguugcccgauuacucuggacaccuaacccugaauaugaaucuugccccagcagucgcgccugccuucccaggugagaggauccuuuucuuuagaucaauagucccaucugccggcggcuaugggucuggacaaauagauugucucauaccacaggaguggguccagcauuucuaucaggaagcugcaccaucccagucugcuguggcucucaucagguaugucaacccugacacgggcagaaacaucuuugaggcaaaauugcacagggaaggcuucaucacuguggcaaauucugguaacaaccccauuguuguccccccuaauggguacuuuagguuugaagcuugggugaaucaauuuuacacuuugacccccaugggaacuggucaggggcgcaggagaaaccaauaa

SEQ ID NO: 6835 - RNA, 1644 nt, Artificial Sequence
  VP1__Norovirus_and/or_Norovirus-like__HQ169542
augaugauggcgucgaaugacgcugcuccauccaaugauggugcugccaaccucguaccagaggccaacaaugagguuauggcacuugaaccgguggugggagccucaauugcagcuccugucgucggucaacaaaauauaauugaccccuggauuagagaaaauuuuguucaggcaccacagggugaguuuacuguuucaccaagaaacucgccuggugagaugcuuuuaaaucuugaauuaggcccagagcucaauccuuaccugagucauuuaucccgcauguauaaugguuaugcugguggcaugcagguucaggugguccuagcugggaaugcguucacagcugguaaaaucaucuuugccgccguuccaccacauuucccuguagagaauauuagugcagcccaaaucacaaugugcccccaugugauuguugaugugagacagcuugagccuguacuuuugccccuuccugacauaaggaauagauucuuucacuacaaccaggaagacaccccccggaugagacuuguggccauguuguacacaccucuuagagcaaacucuggagaggacguguucacagugucuugcagggucuugacccgcccagccccugacuuugaguucacguucuuagugccaccaaccguagaaucaaagaccaagccuuucacacucccuauuuuaacccuaggggaacuauccaacuccagauucccugcuccaauagacaugcuguacacagaucccaaugagacaauuguaguacaaccacaaaauggcagaugcacucuagaugggacacuccaagggaccacccagcuggugcccacccaaauuugcucuuuuaggggcacguuggucagccaaacgucgaggucugcagauucaacagauucagcuccacgggugaggaaccauccccuucacguucagcugaagaaccuugacgggacaccauaugacccaacagaugagguaccggcaguucugggugccauagauuucaaaggaacuguguuuggagucgcuagccagagaaacaccacagggggcucuguaggggcgacccgugcccaugaggugcacauagauacuacaaacccuagauacaccccaaaacuugguucuguguugauguauucugagucuagugauuuugaugauggacaaccgacucgcuucacccccaucggcaugggagcagaugauuggcgccaaugggaauugcccgaauauucuggucaccuuacucuuaacaugaaccuagcccccgcaguugccccugcuuuccccggugagcgcauccucuucuucaggucagugguuccaucugcuggugguuacggaucaggacaaauagacugccucaucccacaggaguggguucagcacuucuaccaggaggccgccccaucacaaucugcgguggcucuuauuagauauguuaacccugacacugggagaaacaucuuugaggcaaagcuacauagagaaggguucaucacuguggcaaauucuggaaacaaccccauagucgugcccccaaaugguuauuucagguuugaggccugggucaaucaauuuuacacacucacccccaugggaacuggacaggggcguaggagaguccaauaa

SEQ ID NO: 6836 - RNA, 1644 nt, Artificial Sequence
  VP1__Norovirus_and/or_Norovirus-like__KX228762
augaagauggcgucgaaugacgcugcuccaucgaaugauggugcugccaaccucguaccagaggccaccaaugagguuauggcacuugagccgguggugggagccucaauugcugcuccugucgucggccaacaaaauauaauugaccccuggauuagagaaaauuuuguucaggcaccacagggugaguuuacuguuucaccaaggaacucaccuggugagaugcuucuaaaucuugaauuaggcccugagcucaacccuuaucugagucacuugucccgcauguauaacggcuaugcuggugguaugcagguucaggugguccuagcugggaaugcguucacagcugguaaaaucaucuuugccgccgucccaccacauuucccuguugagaacauuagugcagcccaaaucacaaugugcccccauguaauuguugauguaagacagcuugagccagugcuuuugccccucccugauauaaggaauagauucuuucauuauaaccaggaaaauaccccccggaugaggcuuguggcuauguuguauacaccccuuagagcaaauucuggugaggauguguuuacggugucuugcagaguucugacccgcccugcccccgacuuugaguucacguuuuuggugccaccaacuguggagucaaagacuaagcccuuuacacucccuauccugacucuuggagagcuguccaacuccagauuccccgcuccgauagacauguuguacaccgaccccaaugaggcaauuguggugcaaccacaaaauggcaggugcacucuagauggaacacuucaagggaccacccaacugguacccacccaaauuugcuccuucaggggcacgcuaauuagccagacgucgaggucugcagauucaacagauucagccccacgggugaggaaccacccucuccacguucagcugaagaaccucgaugggacaccauaugacccaacagaugaggugccagcaguuuugggugccauagauuucaaaggaacuguguuuggggucgcuagccaaagaaacaccacagggaacucuauaggagcaacccgcgcccaugaagugcacauagacaccacaaacccuagauacaccccaaagcuuggcucuguguugaugcauucugaaucuaaugauuuugaugauggacaacccacccgcuuuacccccauuggcaugggagccgaugauuggcaccaaugggaauugcccgaauauucuggucaccucacucuuaacaugaacuuggcccccgcaguugccccugcuuucccuggugagcgcauucuauucuucagaucaguggugccgucugcugguggcuauggaucaggucacauagauugccucaucccacaggaguggguucagcauuucuaccaggaggccgcuccaucacaguccgcgguggcucuuaucagauaugucaacccugacacuggaagaaacaucuuugaggcaaaacugcauagagaaggguucaucacuguggcaaauucuggaaacaaccccauaguugugcccccaaaugguuacuucagguuugaggccugggucaaucaauucuacacacucacccccaugggaacuggacaggggcgcagaagaguucaauaa

SEQ ID NO: 6837 - RNA, 1644 nt, Artificial Sequence
  VP1__Norovirus_and/or_Norovirus-like__AF414410
augaagauggcgucgaaugacgcugcuccaucgaaugauggugcugccaaccucguaccagaggccaacaaugagguuauggcacuugaaccaguggugggagccucaauugcagcuccugucguuggucaacaaaauauaauugaccccuggauuagagaaaauuuuguucaggcaccacagggugaguuuacuguuucaccaaggaacucaccuggugagauacuucuaaaucuugaauuaggcccagagcuuaauccuuaucugagucauuugucccgcauguacaacgguuaugcuggugguaugcagguucaggugguccuagcugggaaugcguucacagcugguaaaaucaucuuugccgccguuccaccacauuucccuguagagaauauuagugcagcccaaaucacaauguguccucaugugauuguugauguaagacagcuugagccaguguuuuugccccuccccgacauaaggaauagguucuuccacuacaaucaagaaaacacuccccgaaugagacuuguggcuauguuguauacaccccuuagagcaaauucuggugaggauguguucacagugucuugcagggucuugacccgcccagcccccgacuuugaguuuacguucuuagugccaccaacuguggagucaaagacuaagccuuucacacuccccauccugacucuuggagagcuauccaacuccagauuccccgcuccaauagacaugcuguacacagaucccaaugagacaauuguggugcaaccacaaaacggcagaugcacccuagauggaacacuucaaggaaccacccaacuggugcccacccaaauuugcuccuuuaggggcacguuaauuagccagacgucgaggucugcagauucaacagauucagcuccgcgggcaaggaaccacccucuccacguucagcugaagaaccucgaugggacaccauaugauccaacagaugagguaccggcaguuuuaggugccauagauuuuaaaggaacuguguuuggaguugcuagccaaagaaacaccacagggagcucgguaggagcgacccgcgcccaugaggugcacauagacacuacagacccuagauacacuccaaaacuugguucuguguugauguauucugagucuaaugauuuugaugauggacagcccacucgcuucaccccuauuggcaugggagccgaugauuggcaccaaugggagcuacccgaauauucuggucaucuuacucuuaacaugaacuuggcccccgcaguugccccugcuuuucccggugagcguauccucuucuucaggucaguggugccaucugcuggugguuaugggucaggccaaauagauugccucaucccacaggaauggguucagcacuucuaucaggaggccgccccaucacaaucugcgguggcccuuauuagguaugucaauccugacacugggagaaacaucuuugaggcaaaguuacauagagaaggguucaucaccguggcaaauucuggaaacaaccccauaguugugcccccaaaugguuacuucagguucgaggccuggguuaaucaauucuacacacucacccccaugggaacuggacaggggcgcagaagaguucaauaa

SEQ ID NO: 6838 - RNA, 1644 nt, Artificial Sequence
  VP1__Norovirus_and/or_Norovirus-like__KU935739
augaagauggcgucgaaugacgcugcuccaucgaaugauggugcugccaaccucguaccagaggccaccaaugagguuauggcacuugagccgguggugggagccucaauugcugcuccugucgucggccaacaaaauauaauugaccccuggauuagagaaaauuuuguucaggcaccacagggugaguuuacuguuucaccaaggaacucaccuggugagaugcuucuaaaucuugaauuaggcccugagcucaacccuuaucugagucauuugucccgcauguauaacggcuaugcuggugguaugcagguucaggugguccuagcugggaaugcguucacagcugguaaaaucaucuuugccgccgucccaccacauuucccuguugagaacauuagugcagcccaaaucacaaugugcccccaugugauuguugauguaagacagcuugagccagugcuuuugccccuuccugacauaaggaauagauucuuucauuauaaucaggaaaauaccccccggaugagacuuguggcuauguuguacacaccccuuagagcaaauucuggugaggauguguuuacugugucuugcagaguucugacccgcccugccccugacuuugaguucacguuuuuggugccaccaacuguggagucaaagacuaagcccuuuacacucccuauucugacucuuggagagcuguccaacuccagauuccccgcuccgauagacauguuguacacugaccccaaugaagcaauuguggugcaaccacaaaauggcaggugcacacuagauggaacacuucaggggaccacccaacugguacccacccaaauuugcuccuucaggggcacgcuaauuagccagacgucgaggucugcagauucaacagauucagccccacgggcgaggaaccacccucuccacguucagcugaagaaccucgaugggacaccauaugacccaacagaugaggugccagcaguuuuaggcgccauagauuucaaaggaacuguuuuuggagucgcuagccaaaggaacaccacagggaacucuauaggagcaacccgcgcccaugaagugcacauagacaccacaaacccuagauacaccccaaagcuuggcucuguguugauguauucugaaucuaaugauuuugaugauggacaacccacccgcuucacccccaucggcaugggagccgaugauuggcaccaaugggaauugcccgaauauucuggucaccucacucuuaacaugaauuuggcccccgcaguugccccugcuuucccuggugagcgcauucucuucuucagaucaguggugccgucugcugguggcuauggaucaggucacauagauugccucaucccacaggaguggguucagcauuucuaccaggaggccgccccaucacaguccgcgguggcucuuaucagauaugucaacccugacacuggaagaaacaucuuugaggcaaaacugcauagagaaggguucaucacuguggcaaauucuggaaacaaccccauaguugugcccccaaaugguuacuucagguuugaggccuggguuaaucaauucuacacacucacccccaugggaacuggacaggggcgcagaagaguucaauaa

SEQ ID NO: 6839 - RNA, 1644 nt, Artificial Sequence
  VP1__Norovirus_and/or_Norovirus-like__KX268709
augaagauggcgucgaaugacgcugcuccaucgaaugauggugcugccaaccucguaccagaggccaccaaugagguuauggcgcuugagccgguggugggagccucaauugcugcuccugucgucggccaacaaaauauaauugaccccuggauuagagaaaacuuuguucaggcaccacagggcgaguuuacuguuucaccaaggaacucaccuggugagaugcuucuaaaucuugaacuaggcccugagcucaacccuuaucugagucacuugucccgcauguauaacggcuaugcuggugguaugcagguucaggugguccuagcugggaaugcguucacagcugguaaaaucaucuuugccgccgucccaccacauuucccuguugagaacauuagugcagcccaaaucacaaugugcccccauguaaucguugaugugagacagcuugagccagugcuuuugccccucccugacauaaggaauagauucuuucauuauaaccaggaaaauaccccccgaaugagacuuguggcuauguuguauacaccccuuagagcaaauucuggugaggauguguuuacggugucuugcagaguucugacccgcccugcccccgacuuugaguucacguuuuuggugccaccaacuguggagucaaagacuaagcccuuuacacucccuauucugacucuuggagagcuguccaacuccagauuccccgcuccgauagacauguuguacacugaucccaaugaggcaauuguggugcaaccacaaaauggcaggugcacucuagauggaacacuucaagggaccacccaacugguacccacccaaauuugcuccuucaggggcacgcuaauuagccagacgucgaggucugcagauucaacagauucagccccacgggcgaggaaccacccucuccacguucagcugaagaaccucgaugggacaccauaugacccaacagaugaggugccagcaguuuugggugccauagauuucaaaggaacuguguuuggggucgcuagccaaagaaacaccacagggaacucuauaggagcaacccgcgcccaugaagugcauauagacaccacaaacccuagauacaccccaaagcuuggcucuguguugaugcauucugaaucuacugauuuugaugauggacaacccacccgcuuuacccccauugguaugggagccgaugauuggcaccaaugggaauugcccgaauauucuggucaccucacucuuaauaugaauuuggcccccgcaguugccccugcuuucccuggugagcgcauucucuucuucagaucagugguaccgucugcugguggcuauggaucaggucacauagauugccucaucccacaggaauggguucagcauuucuaccaggaggccgcuccaucacaguccgcgguggcucuuaucagauaugucaacccugacacuggaagaaacaucuuugaggcaaaacugcauagagaaggguucaucacuguggcaaauucuggaaacaaccccauaguugugcccccaaaugguuacuucagguuugaggccugggucaaucaguucuacacacucacccccaugggaacuggacaggggcgcagaagaguucaauaa

SEQ ID NO: 6840 - RNA, 1644 nt, Artificial Sequence
  VP1__Norovirus_and/or_Norovirus-like__KX158282
augaagauggcgucgaaugacgcugcuccaucgaaugauggugcugccaaccucguaccagaggccaccaaugagguuauggcacuugagccgguggugggagccucaauugcugcuccugucgucggccaacaaaauauaauugaccccuggauuagagaaaauuuuguucaggcaccacagggugaguuuacuguuucaccaaggaacucaccuggugagaugcuucuaaaucuugaauuaggcccugagcucaauccuuaucugagucacuugucccgcauguauaacggcuaugcuggugguaugcagguucaggugguccuagcugggaaugcguucacagcugguaaaaucaucuuugccgccgucccaccacauuuuccuguugagaacauuagugcagcccaaauuacaaugugcccccauguaauuguugaugugagacagcuugagccagugcuuuugccccucccugauauaaggaauagauucuuucauuauaaucaggaaaacaccccucggaugagacuuguggcuauguuguacacaccccuuagagcaaauucuggugaggauguguuuacagugucuugcagaguucugacccgcccugcccccgacuuugaguucacguucuuggugccaccaacuguggagucaaagacuaagcccuuuacacucccuauucugacucuuggagaacuguccaacuccagauuccccgcuccgauagauauguuguacacugacccuaaugaggcaauuguggugcaaccacaaaauggcaggugcacucuagauggaacacuucaagggaccacccaacugguacccacccaaauuugcuccuucaggggcacgcuaauuagccagacgucgaggucugcagauucaacagauucagccccacgggugaggaaccacccucuccacguucagcugaagaaccucgaugggacaccauaugacccaacagaugaggugccagcaguuuugggugccauagauuucaaaggaacugugcuuggggucgcuagucaaagaaacaccacagggagcucuauaggagcaacccgcgcccaugaagugcacauagauaccacaaacccuagauauaccccaaagcuuggcucuguguugaugcauucugaauccacugauuuugaugauggacagccuacccgcuuuacccccauuggcaugggagccgaugauuggcaccaaugggaauugccugaguauucuggucaccuuacucuuaacaugaauuuggcccccgcaguugccccugcuuucccuggugagcgcauucucuucuucagaucaguggugccaucugcugguggcuauggaucaggucacauagauugucucaucccacaggaguggguucagcauuucuaccaggaggccgcuccaucacagucugcgguggcucuuaucagauaugucaacccugacacuggaagaaacaucuuugaggcaaaacugcauagagaaggguucaucacuguggcaaauucuggaaacaaccccauaguugugcccccaaaugguuacuucagguuugaggccugggucaaucaauucuacacacucacccccaugggaauuggacaggggcgcagaaggguucaauaa

SEQ ID NO: 6841 - RNA, 1644 nt, Artificial Sequence
  VP1__Norovirus_and/or_Norovirus-like__AB126320
augaagauggcgucuagcgacgcugcuccaucuacggauggauccgcccgucucguaccagaggucaacaaugagaccauggccuuggaaccaguggugggcgcuccucuugcugcucccguugcuggucaacauaauauuauagaccccuggauuaaaaugaauuuugugcaggcacccaauggagaauuuacuguuuccccccgcaaugccccaggugagauuuugcuagauuuggaauuaggccccgaucuuaacccuuaucuuucacauuuggcucgcauguacaaugguuacgcagguggcauggaggugcaagucguguuagccggcaaugccuucaccgcugggaagauuauuuuugccgcugucccaccgaacuuuccggcagaaaaucuuagcgcagcgcaagucaccauguguccccaugugauaguugauguuagacaauuggaaccaguuaugcucccuaugccugauauuaggaacaaauuauuucauuacaaucaaguggaugacccaaagcuuagauuacuggccuaucuuuauacgccccuucgggccaacaaugcuggggaugauguuuuuacaguuucuugucggguucuuaccagaccaaccccagacuuugaauuuauguuuuugguucccccuacuguugaaucuaaaacuaagccuuucucuuugccuagucuuacucuugaugaacuuucuaauuccagauuucccgcaccuauagugcaacuguacacaaauccccaugacaauuugguuguucagccucagaauggaagaugcaccauagauggucuccugcagggcacuacgcaacuugugucuuguaauguuugcagcuuuagggggacuauuggugauggccagccggccagccacagugaggaggagaucaugcccauggcuuucaacauccagcgagaaaucaugcuggagaaccuugauggcacacccuaugacccagcugaugacaucccugcaguauugggcucccccgauuuucagggggucauauuuggcauccuuagccagagaaacacugacgggcaaaccagggcucaugaagccaagguggacaccagggcggcucguuucgcccccaagcuugguuuugucguggccaccguagagagcacagauuuccacgccaaccaaccuaguagguucaccccuguuggguugggcggugacaacaaccaagauuucaaccaguggcgguugccggccuacggcggcgcacugacgaauaacaccaaucuugccccgcccgugaugccugucuauccaggagagcagcuucucuucuuucgcucccaacuaccaagcucugguggugugguuggcggguggcuggacugccugcucccccaggaguggguucaacacuuuuuccaggagucggccaccucucaaagcgauguggcccuagucagguauauaaaccccaccacaggcagggugcucuuugaggcaaaguuacauaaacaggguuuucucacuguggcugcuucagguuccuauccucugguuguucccgcugauggcuacuuuagauuugaaucuugggugaaucaauuuuacaccuuggcccccaugggaaaugguagugggcgcaggagagcucguuaa

SEQ ID NO: 6842 - RNA, 1644 nt, Artificial Sequence
  VP1__Norovirus_and/or_Norovirus-like__AY077644
augaagauggcgucuaaugacgcuuccccaucugcggauggauccgccggucucguaccagaggucaacaaugagaccauggcccuagaaccaguggugggugcuccccuugcugcuccuguugcuggucaacauaauaucauagaccccuggauuaaaaugaauuuugugcaggcaccuaauggagaauuuacuguuuccccucgcaaugccccaggugagauuuuguuagauuuagagcuugguccugaucuuaaucccuauuuaucacauuuggcccgcauguacaaugguuaugcaggugguauggaggugcaaguugugcuagccggaaaugccuuuacugccggaaagauuaucuuugcugcuguuccaccaaauuuuccagcagagaaccuuagcgcagcacagguuaccaugugcccccaugugauaguugauguuagacaacuggagccaguuaugcuacccaugccugauauuaggaacaaauuguuucauuacaaccaaguugaugacccaaaacuuagacugcuagcuuaucuuuauacaccccuucgggccaacaaugcuggggaugauguuuuuacaguuucuugccggguucuuaccaggccgacuccagacuuugaguuuauguuucuggugccccccacuguugagucuaaaacuaagccuuuuucuuugcccagccuuacucuugaugaacuuucuaacuccagguuucccgcaccuauaguacaacuuuauacaaacccccaugauaauuugguugugcagccccaaaauggaagauguacuauagauggucucuuacagggcaccacacagcuugugucuuguaauguuuguagcuuuagagggacccucggugauggccaaccagcaagucacagugaggaggagaucaugcccauggcuuucaacauccaacgugaaauuaugcuggaaaaccuugauggcucacccuaugacccaacugaugauauuccugcaguguugggcucuccugauuuucaagggguuguguuuggcauucuuagccagagaaacacugacgggcagacuagggcgcaugaagccaaaguggacaccagguuggcucguuucgcccccaaacuuggcuuugucguggccaccguggagaauacagacuuccacgccaaccaaccuugcagguucaccccuguuggguuagguggggacaacaaccgggauuucaaccaguggggucugccagccuaugguggcgcacugacgaacaacaccaaccuugccccgcccgugaugcccgucuacccaggugaacagcuccuuuucuuccguucccaguugccaagcucugguggugugguugguggguggcuggacugccuacucccucaggaauggguccagcacuuuuuccaagaaucagccacuucucagagugauguggcuuuagucagguacauaaaccccaccacaggcagaguacuuuuugaggcaaaauuacacaaacaaggcuuccucacuguagccgccucaggcuccuauccuuuaguuguuccugcugaugguuauuuuagguuugaaucuugggugaaccaguuuuacacuuuagcccccaugggaaauggcagugggcgcaggagaguucguuaa

SEQ ID NO: 6843 - RNA, 1644 nt, Artificial Sequence
  VP1__Norovirus_and/or_Norovirus-like__AY823306
augaagauggcgucuagugacgcugcuccaucuagugauggcagugccggucucguaccagaggucaacagugagaccauggcccuggaacccguggugggugcuccccuugccgcacccguugcgggacaacauaacauaauugaccccuggauuaaguuaaauuuuguucaagccccuaauggugaauuuacaguguccccccguaaugccccgggugaaauucuuuuagauuuggagcuaggaccugaccugaaucccuauuuggcccauuuguccagaauguauaaugcauaugcaggggguauggaagugcaaguuauuuuggcagguaaugcuuuuacggcagggaaaauuauuuucgcugcggugccacccaauuuuccccuugaaaauuugagugcagcccaaauuaccaugugcccccacauuauaguugaugugagacaauuagaaccaguuaugcuccccaugccugaugugaggaauaggcuuuuucacuauaaucaagucagggaaccuagacucagauugguggccuaucucuacacgcccuugagagcaaauaacgcgggugaugacguuuuuacagucucgugccgcguuuugaccaggccaucacaggauuuugaguuuauguuuuuggucccuccuucaguugagucuaagacuaagcccuuuucccuccccaaccuuacccuagcugagcuuucuaauucuagauuucccuugcccauagaacaacuuuauacaaauccccuugauaauuuggugguucagccgcagaaugggaggugcaccaucgaugggauuuuacuugggacgacacagcugguuccuucauugauuuguucgaugagggguaccuuggaggcagaccaagcaucggggcacacugaugacgagagugugcagucgcgugcguucaaccgccaacgaagccuuauguuggagaacccugacgggucggcuuuugacccaucggaugaaguccccgcggugcuuggugucccagacuuccgcgggguuguuuuugguguccucagccagagaaauaacggcgacaccaccagaucgcaugaggccaagauugacacgcgccgaccacgcuaugcucccaagcuggguuuugucgaggugcucacugagagugaugauuuccaaaacggaccucccacaaaauuuacaccgguuggccuggggggggauggcaauccggauuuccaacagugggcccucccugauuauggcggugcauugaccaacaauaccaaccuugcuccacccguugugcccguguacccaggugaacaaauucuuuucuuucgcucccaacuuccaagcucaggugguacaguugcuggguggcuugauugucuccuaccucaagaguggauccagcauuuuuaccaggacucugcagcagcucagagugacguggccuugguuagauacaucaaccccgccacaggcaggguccuuuuugaggccaagcuccaccgacaaggcuuuuugaccgugucagccgccgggccccaucccguaguggcaccagcugauggcuauuuuagguucgaguccugggugaaucaauuuuacacuuuggcccccaugggaaauggaagugggcguaggaggguuuaa

SEQ ID NO: 6844 - RNA, 1638 nt, Artificial Sequence
  VP1__Norovirus_and/or_Norovirus-like__KF586508
augaugauggcgucuaaggacgcuaccucaaacauggauggcaccagcggagcuggacagcuggugccagagaauaauaacaccucagaaccaaucaacauggaaccagucgcgggcgcgguuacugccgcagcuacggcuggccaggugaauaugauugauccuuggauaaugaauaauuauguacaagccccccagggcgaguucacaauuucgcccaauaauacuccuggugauauauuguuugaucuucaauuagguccccaucugaaccccuuucuugcucauuuaucccaaauguauaauggauggguugguaacaugaaagucagggugguguuggcuggcaaugcuuuuucugcgggaaagaucauagugugcuguauaccaccuggauucucugcaccaaacauauccauagcccaggcaacuauguucccucauguuauugcugauguucgggucuuggagcccauugauauuccccuugaugaugucaggaauguucuguuucauaauaaugauaaugguaaucagacuaugagauugcugugcauguuguauacaccacuccguaguggaggcacauccaguggaacugacccguuugugauugcugguaggguucuaaccugcccuacuccagauuuuaauuucuuguucuugguucccccaaccguugagcaaaagaccaaacaguuuagugugccuaaccuuccccucaauguuaugucuaauucuagaguuccaucacuccuaaaugcuaugguggugucaccagaucaggcccaaguggugcaauuucaaaauggcaggugcacccuugaugggcaaauguugggcaccaccacuguaucagcuagcuguguugcaagauucagagggaaaacuuuucaagccccugacaacagguuagguaucaaucuggcugaaauuaguggagaaccauaccaugcauuugaaagcccugccccccuagguuucccugacuuuggggauggagauuggcacgucacugcaacaaaaguaacccccucacagcuugaggcuaaugacccuguggucauggggaauguccaaccauauaacccacaguuugccccucaccugggcacccuagucguagaaaacccuacuccagacaaugugaccaccgggacugacuuauuguucaacauaaccuggcuuuccaaucgugccaauaaucgguuuaacccuuggguuaucccaaauuaugguucaacucucacugaggcagcacagcuggcaccuucaauauuucccccuggcuuuggugaaacuauaguguauuucaauuccacuuuuccagcugugggggccaccacccaugcagcuauacccugucugcuuccacaagaauuuguugcucauuuuguuaaugaacaggcccccauacguggagaggcugcuuugcuccacuacauugacccugauacucaccguaaucuuggugaguucaaaauuuauccagagggcuuuguaacguguguuccuaauguggguggcacggggccacaaucucuaccuacuaaugguaucuuugucuuugucucuugggugucaagguacuaucaacucaagccugugggaacugcuggucaagcaaggcggcuuuaa

SEQ ID NO: 6845 - RNA, 1638 nt, Artificial Sequence
  VP1__Norovirus_and/or_Norovirus-like__HQ637267
augaugauggcgucuaaggacgcuaccucaaacauggauggcaccagcggagcuggacaacuggugccagagaauaacaacaccucagaaccaaucaauauggaaccagucgcgggcgcggucacugccgcagcuacggcuggccaggugaauaugauugauccuuggauaaugaauaauuaugugcaagccccccagggugaguucacaaucucacccaauaacaccccuggugauauauuguuugaucuucaauuggguccccaucuuaaccccuuucuugcucauuuaucccaaauguauaauggauggguugguaacaugaaagucagaguggugcuggcuggcaaugccuucucugcgggaaagauuauagugugcuguauaccaccuggauuuucugcaccaaacauaucuauagcccaggcaacuauguucccacauguuauugcugauguucgggucuuggagcccauugauaucccccuugaugaugucaggaauguuuuguuucauacuaaugauaaugguaaucagaccaugagauuguugugcauguuauacacaccacuucguaguggggguacauccagugggacugacccauuuguaauugcugguaggguccuaaccuguccuacuccagauuuuaauuuucuguuuuuaguucccccaaccguugagcagaagaccaaacaguuuaguguaccgaaccucccccucaauguuaugucuaacucuagaguuccaucacugcugaaugccaugguugugucaccagaucaggcccaaguggugcaauuucagaaugguaggugcacccuugaugggcaaauguuaggcaccacuacuguaucagcuaguuguguugcaagauucagagggaaaacuuuucaagccccugacaacagguuagguauuaaucuggcugaaauuaguggagaaccauaucaugcauucgaaagccccgccccccuagguuuccccgauuuuggggauggagauuggcaugucacugcaacaaaaguaacccccucacagcuugaagcuaaugauccuguggucguggggaauguccaaccauacaauccacaguuugccccucaccugggcacccuaguuguagaaaaccccaccccagaccaaguggccaccgggacugaucuauuauucaacauaaccuggcuuuccaaucgugccaacaaucgguuuaacccuugggucauuccaaauuaugguucaacucucacggaggcggcacagcuggcaccuucaauauuuccccccggcuuuggugaaacuauaguguauuuuaauuccacuuuuccagcagugggugccaccacccaugcagcuauacccuguuugcuuccacaagaauuuguugcucauuuuguuaaugagcaggcccccauacguggagaggcugcucugcuccacuauauugacccugacacucaccguaaucuuggugaguucaaaauuuauccugagggcuuugugacgugugucccuaauguggguggcacagggccacaaucucuaccuacuaauggugucuuugucuuuguuucuugggugucaagguauuaucaacucaagccugugggaacugcuggucaagcaagacggcuuuaa

SEQ ID NO: 6846 - RNA, 1629 nt, Artificial Sequence
  VP1__Norovirus_and/or_Norovirus-like__AY134748
augaagauggcgucgaaugacgccgcuccaucuacugauggugcagccggccucgugccagaaaguaauaaugaggucauggcucuugagcccguggcuggugcugccuuggcagccccggucaccggucaaacaaauauuauagacccuuggauuagagcaaauuuuguccaggccccuaauggugaauuuacaguuucuccccguaaugccccuggugaagugcuauuaaaucuagaauuggguccagaauuaaauccuuaucuggcacauuuagcaagaauguacaacggguaugccggugggauggaggugcaggucaugcuagcugggaacgcguucacagcuggcaaauuggucuucgcugcuguaccaccucauuucccgguugaaaaccuuaguccacagcaaauuaccauguucccucaugugauuauagauguuaggacuuuggaaccuguuuuauugccacuccccgauguuagaaauaauuucuuccauuauaaucaaaaagaugauccuaagaugagaauuguggcuaugcuuuauacuccccucagguccaaugguucuggugaugauguguucacagucucuugcaggguguugacuagacccuccccugauuuugauuuuacauaccugguaccaccaacaguggaauccaaaacaaaaccauucacccuuccaauucuuacacuuggggagcuuuccaauucuagauuuccaguguccauagaucagauguacacuagccccaaugaagucauaucugugcagugccagaauggaaggugcacacuggauggggagcuccaaggaacaacacagcuccaaguuaguggcauuugugcauucaaaggagaagugaccgcucacuugcaggacaaugaucaccuauacaacaucaccaucacaaacuugaauggguccccuuuugaucccucugaggacauccccgccccccugggugugcccgacuuucagggaagagucuuuggugucaucacucaaagagacaaacagaaugccgcugggcaaagccagccggcaaacaggggacacgaugcugugguccccacuuacacagcccaguauaccccaaaauugggucagguucaaauuggcacauggcagaccgacgaucuuaaagucaaccaaccagucaaauucaccccagucggucucaaugacacagaacauuucaaucaguggguggucccuagguacgcuggugcuuuaaaucuaaacacaaaucuugcccccucuguugcuccaguguuuccaggggagcgucugcucuucuuuagaucauaccucccccuuaagggugguuauggaaacccagcuauugauugccugcuaccacaagagugggugcagcauuuuuaucaggaagcagcccccucaaugagugagguagcccuugucagauacaucaauccggacacuggccgggcgcuguuugaggccaaacuccacagagcugguuucaugacagucucgaguaacaccagugcuccggugguugugccugccaacggauacuucagauuugacucuugggugaaccaauuuuauucucuugcccccaugggaacuggaaaugggcguagaaggauucaguga

SEQ ID NO: 6847 - RNA, 1629 nt, Artificial Sequence
  VP1__Norovirus_and/or_Norovirus-like__AY054300
augaagauggcgucgaaugacgccgcuccaucuacugauggugcagccggccucgugccagaaaguaauagugaggucauggcucuugaacccguggcuggugccgcuuuggcagccccggucaccggucaaacaaauauuauagacccuuggauuagagcaaauuuuguccaggccccuaauggugaauucacaguuucuccccguaaugccccuggugaaguguuauugaaucuagaguuggguccugaauugaauccuuaucuggcacauuuagcaagaauguauaacggguaugcuggugguauggaggugcagguuauguuggcugggaacgcguucacagccggcaaauuggucuucgccgcugugccaccccacuucccgguugaaaaccucaguccacagcaaauuaccauguucccccaugugauuauagauguaaggacuuuggaaccuguuuuauuaccacuccccgauguuaggaauaacuucuuccauuacaaucaaaaagaugaucccaagaugagaauuguggcuaugcuuuacaccccccuuaggucuaaugguucaggugaugauguguucacagucucuuguaggguguugaccaggcccuccccugacuuugauuuuacguaccuggugccaccaacaguggaauccaagacaaaaccauucacccuuccaauccucacauuaggggagcuuuccaauucuagguucccagugcccauagaucagauguucacaagccccaaugaagucauaucugugcagugucaaaaugggaggugcacgcuagauggggagcuccaaggaacaacacagcuccaaguuaguggcauuugugcauuuaagggagaaguaaccgcucacuugcaugauaacgaucaccuauacaaugucaccaucacaaacuugaaugggucucccuuugaccccuccgaggacauccccgcccccuugggcgugccugacuuccagggaagagucuuuggugucaucucucaaagggauaaacagaaugcugcugggcacagugagccagcgaacaggggacacgacgccgugguucccaccuacacagcacaguauacuccaaaacugggucagauucaaauuggcacauggcagaccgacgaccuccaagucaaccaaccagucaaauucaccccaguuggucucaaugauacagaacauuuuaaucaauggguggucccuagauaugcuggugcuuugaaccucaacacaaaucuugcccccucugucgccccaguguuuccaggagagcgcuugcucuucuucaggucauaucuuccccucaaggguggcuauggaaauccagcuauugauugucuacugccacaagagugggugcagcauuuuuaucaggaagcagcccccucaaugagugagguggcccuugucagauacaucaacccagacacuggucgggcacuguuugaggccaagcuccacagagcugguuucaugacagucucaagcaacaccagugcuccggugguugugccugccaacgguuacuucagguuugacucuugggugaaccaauuuuauucucucgcccccaugggaacuggaaaugggcguagaaggguucaguaa

SEQ ID NO: 6848 - RNA, 1629 nt, Artificial Sequence
  VP1__Norovirus_and/or_Norovirus-like__KY485125
augaagauggcgucgaaugacgccgcuccaucuacugauggugcagccggccucgugccagaaaguaacaaugaggucauggcucuugaacccguggcuggugccgccuuggcagccccggucaccggucaaacaaauauuauagacccuuggauuagagcaaauuuuguccaggcccccaauggugaauuuacagucucuccccgaaaugccccuggugaagugcuacugaaucuagaguuggguccagaauuaaauccuuaucuggcacauuuagcaagaauguauaauggguaugccggugggauggaggugcaggucauguuggcugggaacgcguucacagccggcaaguuggucuucgccgccgugccaccccacuucccgguugaaaaccuuagcccacagcaaaucaccauguucccucaugugaucauagaugugagaaccuuggaaccuguuuuauuaccacucccugauguuaggaauaacuucuuccauuauaaccagaaagaugaucccaagaugagaauuguggcuaugcuuuauaccccccucaggucuaaugguucaggugaugauguguuuacagucuccuguagaguguugacuagaccuuccccugacuuugacuucacauaccuggugccaccaacaguggagucuaaaacaaagccauucacccucccaauccucacacuuggggaacuuuccaauucuagguucccaguguccauagaccagauguacaccagcccuaaugaaauuauaucagugcagugucaaaaugguaggugcacacuggacggggagcuccaagggacaacacaacuccaagucaguggcauuugugcuuuuaaaggugaagugaccgcccacuugcaugacaaugaucaccuauauaaugucaccaucacaaacuugaauggguccccuuuugaucccuccgaggauaucccugccccucugggugugccugacuuccagggaaggguuuuugguaucaucucccaaagagauaaacacaauaguccugggcauaaugaaccagcaaacaggggacacgacgcuguggucccuacuuacacagcacaguacacuccaaaacuuggacaaauucaaauuggcacauggcaaacugacgaccuuacagucaaccaaccagucaaauucaccccaguuggacucaaugacacugaacacuuuaaccaauggguggucccuagguaugcuggugcccuaaaccucaauacaaaccuugccccuucuguugcuccaguauuuccaggagagcgccugcucuucuucagaucauacauuccccucaagggcgguuauggaaacccagccauugauugccuacuaccacaagagugggugcaacacuucuaucaggaagcagccccuucaaugagugagguggcccucgucagauacaucaacccggacacuggucgggcacuguuugaggccaagcuccacagagcugguuucaugacggucucgagcaacaccagugccccggugguugugccugccaacggguacuucagauuugauucuugggugaaccaauuuuauucucucgcccccaugggaacugggaaugggcguagaaggguucaauaa

SEQ ID NO: 6849 - RNA, 1629 nt, Artificial Sequence
  VP1__Norovirus_and/or_Norovirus-like__KY485123
augaagauggcgucgaaugacgccgcuccaucuacugauggugcagccggccucgugccagaaaguaacaaugaggucauggcucuugaaccuguggcuggugccgccuuggcagccccggucaccggucaaacaaauauuauagacccuuggauuagagcaaauuuuguccaggcccccaauggugaauuuacagucucuccccgaaaugccccuggugaagugcuacugaaucuagaguuggguccagaauuaaauccuuaucuggcacauuuagcaagaauguacaaugggcaugccggugggauggaggugcaggucauguuggcugggaacgcguucacagccggcaaguuggucuucgccgccgugccaccucacuucccgguugaaaaccuuagcccacagcaaaucaccauguucccucaugugaucauagaugugagaaccuuggaaccuguuuuauuaccacucccugauguuaggaauaacuucuuccauuauaaucagaaagaugaucccaagaugagaauuguggcuaugcuuuauaccccccucaggucuaaugguucaggugaugauguguuuacagucuccuguagaguguugacuagaccuuccccugacuuugacuucacauaccuugugccaccaacaguggagucuaaaacaaagccauucacccucccaauccucacacuuggggaacuuuccaauucuagguucccaguguccauagaccagauguacaccagcccuaaugaaguuauaucagugcagugucaaaaugguaggugcacacuggacggggagcuccaagggacaacacaacuccaagucaguggcauuugugcuuucaaaggugaagugaccgcccacuugcaugacaaugaucaccuauauaauguuaccaucacaaacuugaauggguccccuuuugaucccuccgaggauaucccugccccucugggugugccugacuuccagggaaggguuuuugguaucaucucccaaagagauaaacacaauaguccugggcauaaugaaccagcaaacaggggacaugacgcuguggucccuacuuacacagcacaguacacuccaaaacugggacaaauucaaauuggcacauggcagacugacgaccuuacagucaaccaaccagucaaauucaccccaguuggacucaaugacacugaacauuuuaaccaauggguggucccuagguaugcuggugcccuaaaccucaauacaaaccuugccccuucuguugcuccaguauuuccaggagagcgccugcucuucuucagaucauacauuccccucaagggcgguuauggaaacccagccauugauugccuacuaccacaagagugggugcaacacuucuaucaggaagcagccccuucaaugagugagguggcccucgucagauacaucaacccggacacuggucgggcacuguuugaggccaagcuccacagagcugguuucaugacagucucgagcaacaccagugccccggugguugugccugccaacggauacuucagauuugauucuugggugaaccaauucuauucucucgcccccaugggaacugggaaugggcguagaaggguucaauaa

SEQ ID NO: 6850 - RNA, 1629 nt, Artificial Sequence
  VP1__Norovirus_and/or_Norovirus-like__KY485126
augaagauggcgucgaaugacgccgcuccaucuacugauggugcagccggccucgugccagaaaguaacaaugaggucauggcucuugaacccguggcuggugccgccuuggcagccccggucaccggucaaacaaauauuauagacccuuggauuagagcaaauuuuguccaggcccccaauggugaauuuacagucucuccccgaaaugccccuggugaagugcuacugaaucuagaguuggguccagaauuaaauccuuaucuggcacauuuagcaagaauguacaauggguaugccggugggauggaggugcaggucauguuggcugggaacgcguucacagccggcaaguuggucuucgccgccgugccaccccacuucccgguugaaaaccuuagcccacagcaaaucaccauguucccucaugugaucauagaugugagaaccuuggaaccuguuuuauuaccacucccugauguuaggaauaacuucuuccauuauaaccagaaagaugaucccaagaugagaauuguggcuaugcuuuauaccccccucaggucuaaugguucaggugaugauguguuuacagucuccuguagaguguugacuagaccuuccccugacuuugacuucacauaccuggugccaccaacaguggagucuaaaacaaagccauucacccucccaauccucacacuuggggaacuuuccaauucuagguucccaguguccauagaccagauguacaccagcccuaaugaaauuauaucagugcagugucaaaaugguaggugcacacuggacggggagcuccaagggacaacacaacuccaagucaguggcauuugugcuuucaaaggugaagugaccgcccacuugcaugacaaugaucaccuauauaaugucaccaucacaaacuugaauggguccccuuuugaucccuccgaggauaucccugccccucugggugugccugacuuccagggaaggguuuuugguaucaucucccaaagagauaaacacaauaguccugggcauaaugaaccagcaaacaggggacacgacgcuguggucccuacuuacacagcacaguacacuccaaaacuuggacaaauucaaauuggcacauggcaaacugacgaccuuacagucaaccaaccagucaaauucaccccaguuggacucaaugacacugaacacuuuaaccaauggguggucccuagguaugcuggugcccuaaaccucaauauaaaccuugccccuucuguugcuccaguauuuccaggagagcgccugcucuucuucagaucauacauuccccucaagggcgguuauggaaacccagccauugauugccuacuaccacaagagugggugcaacacuucuaucaggaagcagccccuucaaugagugagguggcccucgucagauacaucaacccggacacuggucgggcacuguuugaggccaagcuccacagagcugguuucaugacagucucgagcaacaccagugccccggugguugugccugccaacggguacuucagauuugauucuugggugaaccaauuuuauucucucgcccccaugggaacugggaaugggcguagaaggguucaauaa

SEQ ID NO: 6851 - RNA, 1629 nt, Artificial Sequence
  VP1__Norovirus_and/or_Norovirus-like__U70059
augaagauggcgucgaaugacgccgcuccaucuacugauggugcagccggccucgugccagaaaguaauaaugaggucauggcucuugagcccguggcuggugcugccuuggcagccccggucaccggucaaacaaauauuauagacccuuggauuagagcaaauuuuguccaggccccuaauggcgaauuuacaguuucuccccguaaugccccuggugaagugcuauuaaaucuagaauuggguccagaauuaaauccuuaucuggcacauuuagcaagaauguacaacggguaugccggugggauggaggugcaggucaugcuagcugggaacgcguucacagcuggcaaauuggucuucgcugcuguaccaccucauuucccgguugaaaaccuuaguccacagcaaauuaccauguucccucaugugauuauagauguuaggacuuuggaaccuguuuuauugccacuccccgauguuagaaauaauuucuuccauuauaaucaaaaagaugauccuaagaugagaauuguggcuaugcuuuauaccccccuuagguccaaugguucuggugaugauguguucacagucucuugcaggguguugacuagacccuccccugauuuugauuuuacauaccugguaccaccaacaguggaauccaaaacaaaaccauucacccuuccaauucuuacacuuggggagcuuuccaauucuagauuuccaguguccauagaucagauguacacuagccccaaugaagucauaucugugcagugccagaauggaaggugcacacuggauggggagcuccaaggaacaacacagcuccaaguuaguggcauuugugcauccaaaggagaagugaccgcucacuugcaggacaaugaucaccuauacaacaucaccaucacaaacuugaauggguccccuuuugaucccucugaggacauccccgccccccugggugugcccgacuuucagggaagagucuuuggugucaucacucaaagagacaaacagaaugccgcugggcaaagccagccggcaaacaggggacacgaugcugugguccccacuuacacagcccaguauaccccaaaauugggucagguucaaauuggcacauggcagaccgacgaucuuaaagucaaccaaccagucaaauucaccccagucggucucaaugacacagaacauuucaaucaguggguggucccuagguacgcuggugcuuuaaaucuaaacacaaaccuugcccccucuguugcuccaguguuuccaggggagcgucugcucuucuuuagaucauaccucccccuuaagggugguuauggaaacccagcuauugauugccugcuaccacaagagugggugcagcauuuuuaucaggaagcagcccccucaaugagugagguagcccuugucagauacaucaauccggacacuggccgggcgcuguuugaggccaaacuccacagagcugguuucaugacagucucgaguaacaccagugcuccggugguugugccugccaacggauacuucagauuugacucuugggugaaccaauuuuauucucuugcccccaugggaacuggaaaugggcguagaaggguucaguaa

SEQ ID NO: 6852 - RNA, 1629 nt, Artificial Sequence
  VP1__Norovirus_and/or_Norovirus-like__LC145808
augaagauggcgucgaaugacgccgcuccaucuacugauggugcagccggccucgugccagaaaguaauaaugaggucauggcucuugaacccguggcuggugccgccuuggcagccccagucacuggucaaacaaauauaauagacccuuggauuagagcaaauuuuguccaggcccccaauggugaauuuacagucucuccccguaacuccccuggugaagugcuacugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuuuccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuccagggaagggucuuuggugucaucucccaaagagacaaacauaacgccccuggacauaaugaaccagcaaacagggcacacgaugccguggucccuacuuauacagcacaguauaccccaaaauugggucagauccaaauuggcacauggcagacugacgaucucacagucaaccaaccagucaaauucaccccaguuggacuuaaugacacugaccauuuuaaccaaugggugguccccagguaugcuggugcccuaaaccuuaacacaaaccuugccccuucuguugcuccaguauuuccaggggagcgucugcucuuuuucagaucauacaucccccucaagggcgguuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauauuucagguuugauucuugggugaaccaauucuauucucucgcccccaugggaacuggaaaugggcgcagaaggauccaauaa

SEQ ID NO: 6853 - RNA, 1629 nt, Artificial Sequence
  VP1__Norovirus_and/or_Norovirus-like__LC145795
augaagauggcgucgaaugacgccgcuccaucuacugauggugcagccggccucgugccagaaaguaauaaugaggucauggcucuugaacccguggcuggcgccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuaggaauaacuucuuccauuauaaucagaaagaugaucccaagaugagaauuguggcuaugcuuuacaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcaggugcacacuggauggggaacuccaaggaacaacacaacuccaagucaguggcauuugugcuuucaagggagaagugacugcccacuugcaugacaaugaccaccuguauaaugucaccaucacaaauuugaauggguccccuuuugaccccuccgaggacauccccgccccucugggcguaccugacuuucagggaagggucuuuggugucaucucccaaagagacaaacacaacaccccuggacacaaugaaccagcaaacagggcacacgaugccguggucccuacuuauacagcacaguauaccccaaaauugggucagauucaaauuggcacauggcagacugacgaucucacaaucaaccaaccagucaaauucaccccaguuggacuuaaugacacugaccauuuuaaccaaugggugguccccagguaugcuggugcccuaaaccuuaacacaaaccucgccccuucuguugcuccaguauuuccaggggagcgucugcucuuuuucagaucauacaucccccucaagggcgguuauggaaccccagccaucgauugccuacugccacaagagugggugcaacauuucuaucaggaagcagccccuucgaugagugagguggcccuugucagauacaucaacccggacacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaaggauucaauaa

SEQ ID NO: 6854 - RNA, 1629 nt, Artificial Sequence
  VP1__Norovirus_and/or_Norovirus-like__AB629941
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaauuuacagucucuccccguaaugccccuggugaagugcuauugaaucuagaguuggguccagaauuaaauccuuaucuggcacauuuagcaagauuguacaacggguaugccggugggauggaggugcaggucauguuggcugggaacgcguucacagccggcaaguuggucuuccccgcugugccaccucacuucccgauugaaaaccuuagcccacagcaaauuaccauguuuccucaugugauuauagauguaaggacuuuggaacccguuuuauuaccacucccugauguuagaaauaauuucuuccacuauaaucagaaagaugaucccaagaugagaaucguggcuaugcuuuacaccccccuuaggucuaaugguucaggugaugacguauucacggucuccugcaggguguugacuagacccuccccugauuuugauuucacauaccuggugccaccaacaguggagucuaaaacaaaaccauucacccucccaauucucacacuuggggaacuuuccaauucuagauucccaguguccauagaccagauguacaccagccccaaugaagucauaucagugcagugucaaaaugguaggugcacacuggauggggagcuccaaggaacgacccaacuccaggucaguggcauuugugcuuuuaagggagaaguaacugcccacuugcaugacaaugaucaccuauacaacaucaccaucacaaacuugaauggguccccuuuugaucccuccgaggacaucccugccccccugggcguaccugacuuucagggaagagucuuugguaucaucucccaaagagacaagcacaauuccccuggacauaaugaaccagcaaauagaggacacgacgcuguggucccuaccuacacagcacaguacacuccaaaauugggucagauucaaauuggcacauggcagaccgacgaucucacagucagccaaccaguaaaauucaccccaguuggacucaaugauauugaacauuuuaaccaaugggugguuccuagauaugcuggugcucuaaaucuuaauacaaaucuugccccuucuguugcuccaguauuuccaggggagcgccuacucuuuuucagaucauauaucccccucaagggugguuauggaaauccagccauugauugccuacuaccacaagagugggugcaacauuucuaccaggaagcagccccuucaaugagugagguggcccuugucagauacaucaacccggauacuggucgggcacuguucgaggccaagcuccacagagcugguuucaugacaguuucaagcaacaccagugccccggugguugugccugccaacggauacuuuagauuugauucuugggugaaccaauucuauucucucgcccccaugggaacugggaaugggcguagaaggguucaauaa

SEQ ID NO: 6855 - RNA, 1629 nt, Artificial Sequence
  VP1__Norovirus_and/or_Norovirus-like__LC145792
augaagauggcgucgaaugacgccgcuccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuagaaauaacuucuuccauuacaaucagaaagaugaucccaagaugagaauuguggcuaugcuuuauaccccccuuaggucuaaugguucaggcgaugauguguuuacagucuccugcagggugcugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucaguacagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugcuccccagguaugcuggugcccuaaaccuuaacacaaaccuugccccuucuguugcuccaguauuuccaggggagcgucugcucuuuuucagaucauacaucccccucaaggguggcuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcgcagaaggauccaauaa

SEQ ID NO: 6856 - RNA, 1629 nt, Artificial Sequence
  VP1__Norovirus_and/or_Norovirus-like__LC145786
augaagauggcgucgaaugacgccgcuccaucuacugauggugcagccggccucgugccagaaaguaauaaugaggucauggcucuugaacccguggcuggcgccgccuuggcagccccagucacuggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuucccggucgaaaaccuuagcccacagcaaauuaccauguucccucaugugauuauagaugucaggacuuuggaaccuguuuuauuaccauuaccugauguuaggaauaacuucuuccacuauagccagaaagaugaucccaagaugagaauuguggcuaugcuuuacaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcaggugcacacuggauggggaacuccaaggaacaacacaacuccaagucaguggcauuugugcuuucaagggagaagugacugcccacuugcaugacaaugaccaccuguauaaugucaccaucacaaauuugaauggguccccuuuugaccccuccgaggacauccccgccccucugggcguaccugacuuucagggaagggucuuuggugucaucucccaaagagacaaacacaacaccccuggacacaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugguccccagguaugcuggugcccuaaaccuuaacacaaaccucgccccuucuguugcuccaguauuuccaggggagcgucugcucuuuuucagaucauacaucccccucaagggcgguuauggaacuccagccaucgauugccuacugccacaagagugggugcaacauuuuuaucaggaagcagccccuucgaugagugagguggcccuugucagauacaucaacccggacacuggucgggcacuguuugaggccaaacuccacagagcugguuucaugacagucucaagcaacaccagugccccggugguugugccugccaacggauacuucagguucgauucuugggugaaccaauucuauucucucgcccccaugggaacuggaaaugggcgcagaaggauucaauaa

SEQ ID NO: 6857 - RNA, 1629 nt, Artificial Sequence
  VP1__Norovirus_and/or_Norovirus-like__LC145793
augaagauggcgucgaaugacgccgcuccaucuacugauggugcagccggccucgugccagaaaguaauaaugaggucauggcucuugaacccguggcuggugucgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuagaaacaacuucuuccauuacaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagguucccaguguccauagaucagauguacaccagccccaaugaagucauaucaguacagugucaaaauggcaggugcacacuggauggggaacuccaaggaacaacacaacuccaagucaguggcauuugugcuuucgagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaucaaugggugguccccagguaugcuggugcccuaaaccuuaacacaaaccuugccccuucuguugcuccaguauuuccaggggagcgucugcucuuuuucagaucauacaucccccucaaggguggcuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaaggauccaauaa

SEQ ID NO: 6858 - RNA, 1629 nt, Artificial Sequence
  VP1__Norovirus_and/or_Norovirus-like__LC145791
augaagauggcgucgaaugacgucgccccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuagaaacaacuucuuccauuacaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagguucccaguguccauagaucagauguacaccagccccaaugaagucauaucaguacagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugguccccagguaugcuggugcccuaaaccuuaacacaaaccuugccccuucuguugcuccaguauuuccaggggagcgucugcucuuuuucagaucauacaucccccucaaggguggcuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaaggauccaauaa

SEQ ID NO: 6859 - RNA, 1629 nt, Artificial Sequence
  VP1__Norovirus_and/or_Norovirus-like__LC145788
augaagauggcgucgaaugacgccgcuccaucuacugauggugcagccggccucgugccagaaaguaauaaugaggucauggcucuugaacccguggcuggcgccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuaggaauaacuucuuccauuauaaucagaaagaugaucccaagaugagaauuguggcuaugcuuuacaccccccuuaggucuaaugguucaggcgaugauguguuuacagucuccugcaggguguugacuagacccuccccugauuuugauuucacauaccuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcaggugcacacuggauggggaacuccaaggaacaacacaacuccaagucaguggcauuugugcuuucaagggagaagugacugcccacuugcaugacaaugaccaccuguauaaugucaccaucacaaauuugaauggguccccuuuugaccccuccgaggacauccccgccccucugggcguaccugacuuucagggaagggucuuuggugucaucucccaaagagacaaacacaacaccccuggacauaaugaaccagcaaacagggcacacgaugccguggucccuacuuauacagcacaguauaccccaaaauugggucagauucaaauuggcacauggcagacugacgaucucgcagucaaccaaccagucaaauucaccccaguuggacuuaaugacacugaccauuuuaaccaaugggugguccccagguaugcuggugcccuaaaccuuaacacaaaccucgccccuucuguugcuccaguauuuccaggggagcgucugcucuuuuucagaucauacaucccccucaagggcgguuauggaacuccagccaucgauugccuacugccacaagagugggugcaacauuucuaucaggaagcagccccuucgaugagugagguggcccuugucagauacaucaacccggacacuggucgggcacuguuugaggccaaacuccacagagcugguuucaugacagucucgagcaacaccagugccccggugguugugccugccaacggauacuucagguuugauucuugggugaaccaauucuauucucucgcccccaugggaacuggaaaugggcgcagaaggauucaauaa

SEQ ID NO: 6860 - RNA, 1629 nt, Artificial Sequence
  VP1__Norovirus_and/or_Norovirus-like__LC145803
augaagauggcgucgaaugacgccgcuccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguauaacggguaugccggugggauggaggugcaggucauguuggcugggaaugcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaccccaagaugagaauuguggcuaugcuuuacaccccccucaggucuaaugguucaggcgaugauguguuuacaguuuccugcaggguguugacuagacccuccccugauuuugauuucacauaucuggugccaccaacaguggaaucuaaaacaaaaccauucacucucccaauccucacgcuuggggaacuuucuaauucuagauucccaguguccauagaccagauguacaccagccccaaugaagucauaucagugcagugccaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccucuuuugaccccucugaggacauccccgccccucugggcauaccugacuuucaggggagggucuuuggugucaucucccaaagagacaaacacaacaccccuggacacaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugauacugaccauuuuaaccaaugggugguccccagguaugcuggugcccuaaaccuaaacacaaaccuugccccuucuguugcuccaguauuuccaggggagcgucugcucuuuuucagaucauacauuccccucaagggcgguuauggaacuccagccaucgauugccuacuaccacaagagugggugcaacauuucuaucaggaagcagccccuucgaugagugagguggcccuugucagauacaucaacccggauacuggucgggcacuguucgaggccaaacuccacagagcugguuucaugacagucucaagcaacaccagugccccggugguugugccugccaacggauacuucagguuugauucuugggugaaccaauucuauucucucgcccccaugggaacuggaaaugggcguagaaggauccaauaa

SEQ ID NO: 6861 - RNA, 1629 nt, Artificial Sequence
  VP1__Norovirus_and/or_Norovirus-like__LC145804
augaagauggcgucgaaugacgccgcuccaucuacugauggugcagccggccucgugccagaaaguaauagugaggucauggcucuugaacccguggcuggcgccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuucccgguugaaaaccuuagcccacagcaaauuaccauguucccucaugugauuauagaugucaggacuuuggaaccuguuuuauuaccacucccugauguuaggaauaacuucuuccauuauaaucagaaagaugaucccaagaugagaauuguggcuaugcuuuacaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcaggugcacacuggauggggaacuccaaggaacaacacaacuccaagucaguggcauuugugcuuucaagggagaagugacugcccacuugcaugacaaugaccaccuguauaaugucaccaucacaaauuugaauggguccccuuuugaccccuccgaggacauccccgccccucugggcguaccugacuuucagggaagggucuuuggugucaucucccaaagagacaagcacaacaccccuggacacaaugaaccagcaaacagggcacacgaugccguggucccuacuuauacagcacaguauaccccaaaauugggucagauucaaauuggcacauggcagacugacgaucucgcagucaaccaaccagucaaauucaccccaguuggacuuaaugacacugaccauuuuaaccaaugggugguccccagguaugcuggugcccuaaaccuuaacacaaaccucgccccuucuguugcuccaguauuuccaggggagcgucugcucuuuuucagaucauacaucccccucaagggcgguuauggaacuccagccaucgauugccuacugccacaagagugggugcaacauuucuaucaggaagcagccccuucgaugagugagguggcccuugucagauacaucaacccggacacuggucgggcacuguuugaggccaaacuccacagagcugguuucaugacagucucgagcaacaccagugccccggugguugugccugccaacggauacuucagguuugauucuugggugaaccaauucuauucucucgcccccaugggaacuggaaaugggcgcagaaggauucaauaa

SEQ ID NO: 6862 - RNA, 1629 nt, Artificial Sequence
  VP1__Norovirus_and/or_Norovirus-like__LC145801
augaagauggcgucgaaugacgccgcuccaucuacugauggugcagccggccucgugccagaaaguacuaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuacaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcgcaccugacuuucagggaagggucuuuggugucaucucccaaagagacaaacacaacaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugguccccagguaugcuggugcccuaaaccuuaacacaaaccuugccccuucuguugcuccaguauuuccaggggagcgucugcucuuuuucagaucauacaucccccucaagggcgguuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaaggauccaauaa

SEQ ID NO: 6863 - RNA, 1629 nt, Artificial Sequence
  VP1__Norovirus_and/or_Norovirus-like__LC145802
augaagauggcgucgaaugacgccgcuccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuguugaaucuagaguuggguccagaauuaaauccuuaucuggcacauuuagcaagaauguauaaugggcaugccggugggauggaggugcaggucauguuggcugggaaugcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuacaccccccuuaggucuaaugguucaggcgaugauguguuuacagucuccugcaggguguugacuagacccuccccugauuuugaauucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcagguguacacuggauggggaacuccaaggaacaacacaacuccaagccaguggcauuugugcuuucaagggagaagugacugcccacuugcaugauaaugaucaccuguauaaugucaccaucacaaacuugaauggguccccuuuugaccccuccgaggacauccccgccccucugggcguaccugacuuucagggaagggucuuuggugucaucucccaaagagacaaacacaacgccccuggacauaaugaaccagcaaacagggcacacgaugccguggucccuacuuauacagcacaguauaccccaaaauugggucagauucaaauuggcacauggcagacugacgaucuuacagucaaccaaccagucaaauucaccccaguuggacuuaaugacacugaccauuuugaccaaugggugguccccagguaugcuggugcccuaaaccuuaacacaaaccuugccccuucuguugcuccaguauuuccaggggagcgucugcucuuuuucagaucauacaucccccucaagggcgguuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaaggauccaauaa

SEQ ID NO: 6864 - RNA, 1629 nt, Artificial Sequence
  VP1__Norovirus_and/or_Norovirus-like__LC145805
augaagauggcgucgaaugacgccgcuccaucuacugauggugcagccggccucgugccagaaaguaauagugaggucauggcucuugaacccguggcuggcgccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuucccgguugaaaaccuuagcccacagcaaauuaccauguucccucaugugauuauagaugucaggacuuuggaaccuguuuuauuaccacucccugauguuaggaauaacuucuuccauuauaaucagaaagaugaucccaagaugagaauuguggcuaugcuuuacaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcaggugcacacuggauggggaacuccaaggaacgacacaacuccaagucaguggcauuugugcuuucaagggagaagugacugcccacuugcaugacaaugaccaccuguauaaugucaccaucacaaauuugaauggguccccuuuugaccccuccgaggacauccccgccccucugggcguaccugacuuucagggaagggucuuuggugucaucucccaaagagacaaacacaacaccccuggacacaaugaaccagcaaacagggcacacgaugccguggucccuacuuauacagcacaguauaccccaaaauugggucagauucaaauuggcacauggcagacugacgaucucgcagucaaccaaccagucaaauucaccccaguuggacuuaaugacacugaccauuuuaaccaaugggugguccccagguaugcuggugcccuaaaccuuaacacaaaccucgccccuucuguugcuccaguauuuccaggggagcgucugcucuuuuucagaucauacaucccccucaagggcgguuauggaacuccagccaucgauugccuacugccacaagagugggugcaacauuucuaucaggaagcagccccuucgaugagugagguggcccuugucagauacaucaacccggacacuggucgggcacuguuugaggccaaacuccacagaguugguuucaugacagucucgagcaacaccagugccccggugguugugccugccaacggauacuucagguuugauucuugggugaaccaauucuauucucucgcccccaugggaacuggaaaugggcgcagaaggauucaauaa

SEQ ID NO: 6865 - RNA, 1629 nt, Artificial Sequence
  VP1__Norovirus_and/or_Norovirus-like__LC145797
augaagauggcgucgaaugacgccgcuccaucuacugauggugcagccggccucgugccagaaaguaauaaugaggucauggcucuugaacccguggcuggugucgccuuggcagccccagucaccggucaaacaaauauaauagacccuuggauuagagcaaauuuugucccggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuagaaacaacuucuuccauuacaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaauuauucacucucccaauccucacgcuuggggaacuuuccaauucuagguucccaguguccauagaucagauguacaccagccccaaugaagucauaucaguacagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaucucuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugguccccagguaugcuggugcccuaaaccuuaacacaaaccuugccccuucuguugcuccaguauuuccaggggagcgucugcucuuuuucagaucauacaucccccucaaggguggcuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaaggauccaauaa

SEQ ID NO: 6866 - RNA, 1629 nt, Artificial Sequence
  VP1__Norovirus_and/or_Norovirus-like__LC145806
augaagauggcgucgaaugacgccgcuccaucuacugauggugcagccggccucgugccagaaaguaauagugaggucauggcucuugaacccguggcuggcgccgccuuggcagccccagucaccggucaaacaaauauaauagacccuuggauuagagcaauuuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuucccgguugaaaaccuuagcccacagcaaauuaccauguucccucaugugauuauagaugucaggacuuuggaaccuguuuuauuaccacucccugauguuaggaauaacuucuuccauuauaaucagaaagaugaucccaagaugagaauuguggcuaugcuuuacaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcaggugcacacuggauggggaacuccaaggaacaacacaacuccaagucaguggcauuugugcuuucaagggagaagugacugcccacuugcaugacaaugaccaccuguauaaugucaccaucacaaauuugaauggguccccuuuugaccccuccgaggacauccccgccccucugggcguaccugacuuucagggaagggucuuuggugucaucucccaaagagacaaacacaacaccccuggacacaaugaaccagcaaauagggcacacgaugccguggucccuacuuauacagcacaguauaccccaaaauugggacagauucaaauuggcacauggcagacugacgaucucgcagucaaccaaccagucaaauucaccccaguuggacuuaaugacacugaccauuuuaaccaaugggugguccccagguaugcuggugcccuaaaccuuaacacaaaccucgccccuucuguugcuccaguauuuccaggggagcgucugcucuuuuucagaucauacaucccccucaagggcgguuauggaacuccagccaucgauugccuacugccacaagagugggugcaacauuucuaucaggaagcagccccuucgaugagugagguggcccuugucagauacaucaacccggacacuggucgggcacuguuugaggccaaacuccacagagcugguuucaugacagucucgagcaacaccagugccccggugguugugccugccaacggauacuucagguuugauucuugggugaaccaauucuauucucucgcccccaugggaacuggaaaugggcgcagaaggauucaauaa

SEQ ID NO: 6867 - RNA, 1629 nt, Artificial Sequence
  VP1__Norovirus_and/or_Norovirus-like__KU306738
augaagauggcgucgaaugacgccgcuccaucuaaugauggugcauccagucucguaccagagaucaacaacgagacaauggcuuuggaaccgguggcgggaggagcuaucgcagccccccuuaccgggcagacaaauuuuauugaucccuggauuagaaauaauuaugugcaagcacccaauggugaguuuacaauauccccuagaaauucuccuggugaaauuuuacuuaauuuggaauugggcccugaacuuaacccauucuuagcccaccuggccagaauguacaauggguaugcuggagguguugauguccaggucaucauggcaggcaaugccuucacugccgguaaagucaucuuugcugcagugccaccccacuucccaguugagagucuuagccccccccaaauuacuauguuuccccauauuauaguggaugucagaacccuugaaccuauaaacauccccauaccugauguuaggaacaauuucuuccauuacaaucagaacaaugagccccguaugagguugguagccauguuguacaccccccuuagaucaaaugguucugcugaugauguuuucacagugucaugcaggguucuaacaaagccuucagcagauuuugaguucaauuauuugguccccccgacagucgaaucaagaacuaaacccuucacaauaccaauacucacaauuggagagaugacaaauucaagauucccuguggccauugacaugcuguacaccagcccaacugaaaaccuggugguccaaccccagaauggcagguguacacuugagggugaguuauuaggcacaacacaguuggugacuccaaacaucugcucccuccguggugcaaucacuggacaugagggcaaugaugacaaucacaaguggcacaugacggucacaaaccccaauggcuccgcuuuugauccaacagaagaugugccugcuccccuaggcaccccagacuucauaggugauguguacggagugcucucccaaaggaauagaaacauagaaucuggccaaacugcucccgcaaacaggucccaugaagcuguuauuuccacaaggagcaacaaauucacaccaaaauugggcucaguaaugauugccacuuggaacacuaaugauguugaaaaccaacccaccaaauucacaccaguaggacuugaaaauccugguucuuuccaccagugggaguugccaaauuacucaggagcuuuaacccucaacauggggcuugcaccaccuguguucccaaccuaccccggcgagcagcuucucuucuuccgcucguacaucccccuuaaggguggguuugggaauucaauaauagauugucuugugccacaagaguggauucaacauuucuaucaagaaucagcccccucacaaacagauguggcuuuaaucagguaugucaaccccgaaacaggacgcguccuuuucgaggccaaauugcacagacaaggguucaucaccgucgccaagacuggugacagccccaucaauguaccugccaauggcuauuuuagauuugacucuuggguuaauucauuuuauucacuugcccccaugggaacugggaaugggcgcagaaggauucaguaa

SEQ ID NO: 6868 - RNA, 1629 nt, Artificial Sequence
  VP1__Norovirus_and/or_Norovirus-like__KM036380
augaagauggcgucgaaugacgccgcuccaucgaaugauggugcagcuagucucguaccagaggccauuaaugagacuaugccauuggaacccguugcuggcgcaucuauugcugccccaguggcgggacagacuaacauaauugaccccuggauaagaacaaauuuugugcaagccccuaauggagaguuuacaguaucaccgagaaauuccccuggagagauucuauuaaauuuagaguuaggaccagacuugaauccuuauuuggcccaucuaucaaggauguacaauggguaugcuggagguguugaggugcaagugcuucuugcugggaacgcguucacagcaggaaagauauuauuugcagcaaucccacccaacuuuccuguagauaugauuagcccagcucaaauuacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugauuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcuguuaucaagugcaguuugcucuuacaggggcaggacuguggcuaacaguggggacaauugggaccagaauuugcuccaguugaccuacccaagcggugcaagcuaugaccccacugaugaaguaccagcacccuugggcacccaagauuucagugggauauuguaugggguguuaacccaggacaauguaagugaggguacaggggaggccaaaaaugcuaagggaguauacauauccaccaccaguggaagauucaccccaaaaauugggacaauuggauugcauucaauaacugaaaaugugcaccccaaucagcaaucacgguucacccccguuggagucgcucagaaugaaaacacccccuuccagcaauggguucuaccacacuaugcaggugcucucgcucuaaacaccaauuuggcacccgcuguugccccgacuuucccuggcgagcaauuacuguucuucaggucccgugucccauguguucaaggucugcgggggcaggaugcuuucauagauugucuccuaccucaagagugggugaaccauuuuuaucaagaggcugcucccucccaagcagacguugcccucaucagguaugucaacccugauacuggucgcacgcuguuugaggccaaauugcacaggucagguuuuauuacuguaucacacacugguaacuacccucuugugguccccccgaauggucauuucagguuugauucuuggguuaaccaauucuacucacucgcccccaugggaacuggcaaugggcguagaagaguucaauaa

SEQ ID NO: 6869 - RNA, 1629 nt, Artificial Sequence
  VP1__Norovirus_and/or_Norovirus-like__AY113106
augaagauggcgucgaaugacgccgcuccaucaaaugauggugcagcuagucucguaccagagggcauuaaugagacuaugccauuggaacccguugcuggugcaucuauugcugccccaguggcgggacaaaccaacauaauagaccccuggauaagaacaaauuuuguacaagccccuaauggagaguuuacagugucaccaagaaauuccccuggagaaauuuuauuaaauuuagaauuaggaccagaucugaauccuuauuuggcccaucuuucaagaauguacaaugguuaugcuggagguguugaggugcaagugcuccuugcugggaacgcguucacagcagguaagauauuguuugcagcaaucccaccuaacuuuccuguagauaugauuagcccagcucaaauuacuaugcuuccccauuugauuguagauguuaggacuuuggaaccuauuaugauacccuugccugauguuaggaauguguucuaucauuuuaacaaucaaccucaaccuagaaugagauuaguagcuaugcucuacaccccauugaggucuaaugguucaggggaugaugucuucacugugucuuguagagugcuaacuaggccuacuccugauuuugaauuuaucuaucuggugcccccuucuguagaguccaaaacuaaaccauucacacuaccaauauuaaccauuucugaauugaccaacucccgguucccuauuccaaucgagcaauuguauacggcuccaaaugagaccaauguuguccagugucagaauggcaggugcaccuuagauggagagcuccagggcacaacccagcuguuaucaagugcaguuugcucuuacaggggcaggacuguggccaauaauggggauaauugggaccaaaaucugcuccagcugaccuauccaaauggugcaagcuaugaccccacugaugaagugccagcaccauugggcacucaagacuuuagugggauguuguauggaguguugacccaggacaaugugaaugugagcacaggagaggccaaaaaugcuaagggaauauacauauccaccacuagugggaaauuuaccccaaaaguugggucaauuggauugcauucaauaacugagcacgugcaccccaaccaacagucgcgguucacccccguuggaguugccgugaaugagaauacccccuuccagcaauggguucugccacauuaugcagguagucucgcucucaacaccaauuuggcaccugcuguugccccgacuuucccuggugagcaauugcuguucuucaggucccgugucccauguguucaaggccuacagggacaggaugcguucauagauugccuccugccccaagagugggugaaucauuuuuaccaagaggcagccccuucccaagcagacgucgcccuuauuagguaugucaacccugauacuggucgcacgcuguuugaagccaaguugcauagaucagguuucauuacugugucacauacuggugcuuacccucuuguaguucccccaaauggucauuuuagguuugauucuuggguuaaucaauuuuacucacucgcccccaugggaacuggcaaugggcguagaaggauccaguaa

SEQ ID NO: 6870 - RNA, 1629 nt, Artificial Sequence
  VP1__Norovirus_and/or_Norovirus-like__AB078334
augaagauggcgucgaaugacgccgcuccaucaaaugauggugcagcuagucucguaccagagggcauuaaugagacuaugccauuggaacccguugcuggcgcaucuauugcugccccaguggcgggacaaaccaacauaauugaccccuggauaagaacaaauuuuguacaagcccccaauggagaguuuacagugucaccaagaaauuccccuggagaaauuuuauuaaauuuagaauuaggaccagaucugaauccuuauuuggcccaucuuucaagaauguacaaugguuaugcuggagguguugaggugcaagugcuccuugcugggaacgcguucacagcagguaagauauuguuugcagcaaucccaccuaacuuucucguagauaugauuagcccagcucaaauuacuaugcuuccccauuugauuguagauguuaggacuuuggaaccuauuaugacacccuugccugauguuaggaauguguucuaucauuuuaauaaucaaccucaaccuagaaugagguuaguggcuaugcucuacaccccauugaggucuaaugguucaggagaugaugucuucacugugucuuguagaguacuaacuaggccaacuccugauuuugaauuuauuuaccuggugcccccuucuguagaguccaaaacuaaaccauucacacuaccaauauuaaccauuucugaauugaccaacucccgguuccccauuccaaucgagcaauuguauacggcuccaaaugaaaccaauguuguccagugucagaauggcaggugcaccuuagauggagagcuccagggcacaacccagcuguuaucaagugcaguuugcuucuuacagggcaggacuguggcugauaauggggauaauugggaccaaaauuugcuccagcugaccuauccaaauggugcaagcuaugaccccacugaugaagugccagcaccauugggcacucaggauuuuagugggauguuguauggaguguugacccaggacaaugugaaugugagcacaggagaggccaaaaaugcuaagggaauauacauauccaccacuaguggaaaauucaccccaaaaauugggucaauuggauugcauucaauaacugagcaugugcaccccaaccaacagucgcgguucacccccgucggagucgccguggaugagaacacccccuuccagcaauggguucugccacauuaugcagguagucucgcucucaacaccaauuuggcaccugcuguugccccgacuuucccuggugagcaauugcuguucuucaggucccgugucccauguguucaaggccuacagggacaggaugcguucauagauugccuccugccccaagagugggugaaucauuuuuaccaagaggcagccccuucccaagcagacguugcccuuauuagguaugucaacccugauaccggucgcacgcuguuugaagccaaauugcauagaucagguuuuauuacugugucacauacuggugcuuacccucuuguaguccccccaaauggucauuucagguuugauucuuggguuaaucaauuuuacucacucgcccccaugggaacuggcaaugggcguagaagaauucaguaa

SEQ ID NO: 6871 - RNA, 1629 nt, Artificial Sequence
  VP1__Norovirus_and/or_Norovirus-like__KM289172
augaagauggcgucgaaugacgcugcuccaucuaaugauggugccgccggccucguaccagagaucaauaaugaggcaauggcgcuagauccaguggcgggugcagcgauagcagcaccccuuacuggccagcaaaacauaauagaucccuggauuaugaauaauuuugugcaagcaccugguggugaguuuacagugucaccuaggaacuccccuggugaaguacuucuaaauuuagaauuaggcccagaaauaaaucccuaucuggcgcaucuugcuaggauguacaaugguuaugcagguggguuugaggugcaagugguccuggcuggaaaugcguuuacagcagggaaagugaucuuugcagcuaucccccccaacuucccaacugacaauuugagugcagcgcagauuacaauguguccucauguaauuguggaugucaggcaguuggaaccaaucaaccucccgaugccugauguccgcaacaacuucuuucauuauaaucaagguucugauucaagguuacgcuuaauugcaauguuguauacaccccuuagggcaaauaauucuggagaugauguuuucacugugucauguaggguauugacuaggcccaguccugacuucucauucaauuuccucgucccgcccacuguggaaucgaagacaaaaccuuuuacccucccuauuuugacuaucucugagaugucuaauucuagauuuccagugccaauugauucucugcacaccaguccaacugauaacauuguuguccagugccaaaaugggcgcgucacccuugacggugagcuaaugggcaccacccaacucuugccgagucagauaugugcuuuuaggggugugcucaccagaucaacaagcagggccagugaccaagcugacacagcaacccccagacucuucaauuacuacuggcacauacaacuagacaaccuaaaugggaccccguaugauccugcagaggacauaccagcuccucuggggacgccagacuuucggggcaaagucuuuggcguagccagccagagaaacccugacaguacaacaagggcacaugaggcaaagguggacacaacaucuggccgcuucaccccaaaauugggcucccuagaaauauccacugaaucuggugacuuugaccaaaaccaaccaacaagauucaccccaguuggcauuggaguugacagugaggcagauuuucaacaauggacccuacccgacuauuccggucaguucacccacaacaugaaccuggccccagcugucgcucccaauuuucccggugaacagcuucuuuucuuccgcucacaguugccauccucuggcgggcgguccaauggcauucuagacugccuggucccccaggaguggguccaacauuucuaccaggaauccgccccugcccaaacgcagguggcucuggucagguaugucaacccugauacugguaggguguuauuugaggcuaagcugcauaagcuaggcuacaugaccauagcuaagaguggugauucuccaauaacuguacccccaaauggauauuuuagguuugaaucuugggugaaucccuuuuauacacuagcccccaugggaacugggaauuaa

SEQ ID NO: 6872 - RNA, 1629 nt, Artificial Sequence
  VP1__Norovirus_and/or_Norovirus-like__AY130762
augaggauggcgucgagugacgcgcccguuucuggcaccgauggugcggcaggacucgucccagagagucaacaagaagucuugccuuuagagcccgucgcgggaguucagcuggcugcucccguagcagggcaaaguaauauaauugaccccuggauuagaaugaauuuuguacaagcuccggccggugaguucacuguguccccucggaacgcgccgggugaggugcuuauugauuuagaauuaggaccagaauuaaaucccuaccuuaaucaccuugcaagaauguauaauggguaugugggaggaauggagguggaaguuguccuugccgggaaugcguucacggcggguaagaucuuauuugcagcugugccccccagcuucccaacccauggcaucucugcagcacaggcaacuauguuaccacaugugauuguggaugucaggcaauuggagccuguccggcucccucucccugacgucaggaaugugauguuccauuucugucaagagaauaaggagccgcgcaugagaaucguggcaauauuguacaccccacuccgagccaacggugcgggugaugauguuuucacugucucaugucgugugcuaacaagacccucaccagauuuugauuuuauuuucuuggucccccccuccguggagaguaaguuaaaacaguuuacccucccaaaucugcagccaaacgagaugaccaauucaagauuccccacugguauuacacagcuuuacaccaguccaaacaccaauuugguuguccaguuccaaaaugguaggugucugcuugauggcacacuccucggcaccaccccugucagagcugcugacaucugcaguuuuagaggggucacgucaacugaaguugaugcaacugacagccccagaguggcagggucacacagaauuaugguacaacuuaaggagccagauggagaggaguuuucacccacaggucccaacccugccccuguuggcacuccagacuuccaagcagccauauuuggcacucucagucaaagaaacacuggcggagcuggccagaauuccaacagagcccacuucgcauacuuuuacacaagaaaccccacauuugcaccaggcauagggacaguuguguuuucuuuugacacuacugauuuccaaaaucgccaaccuacuaaauuuucuccuucugguguguuugaugauaauucuucugagcccuuuaaucaguucucccugccauauuacaaugggucacucggugcaguggacgcugggaaacuggcuccgccuguggcacccaauuauccaggugagcagauucuuuauuuuagagggaauauaccuuucaaagguggguauggagaaggugaaauugacagcuuacuuccccaggaauggauuacccacuuuuaugcagagcaggcccccacacaaggugacgcagcccuucugcgcuacuacaacccugacacuggaagaguccucuuugagugcaaacuccaccgcgagggauucauuacaaucaauuacacaggauccaaugcucuugcuguaccagucaauggagucuucagguucgagggcuggguuaacaaauucuacacauugacccccauguaa

SEQ ID NO: 6873 - RNA, 1629 nt, Artificial Sequence
  VP1__Norovirus_and/or_Norovirus-like__KJ196290
augaggauggcgucgagugacgcgcccguuucuggcaccgauggugcggcaggacucguuccagagagucaacaagaagucuugccuuuagagcccgucgcgggaguccagcuggcugcucccguugcagggcaaaguaacauaauugaccccuggauuagaaugaauuuugugcaagccccggccggugaguucacuguguccccucggaacgcaccgggugagguacuuauugauuuagaauuaggaccagaauuaaaccccuaucucaaccaccuugcaagaauguauaauggguauguaggaggaauggagguggaaguuguucuugccgggaaugcguucacggcagguaagaucuuguuugcagcugugccccccagcuucccaacccaugguaucucugcagcacaggcuacuaugcuaccccaugugauuguggaugucaggcaguuggagccuguucggcucccccucccugacgucaggaaugugauguuucacuucugucaagagaacaaggagccgcguaugagaauuguggcaauauuguacaccccucuccgugccaacggagcuggugaugauguuuucaccgucucaugucgugugcuaacaagacccucaccagauuuugauuuuauuuucuuggucccccccucuguagagaguaaguugaaacaguuuacccucccaaaccugcagccaaaugagaugaccaauucaagauuucccacagguaucacacagcuuuauaccaguccaaacaccaauuugguuguccaguuccaaaauggcaggugccuacuugaugguacacuucuugguacuaccccugucagagcugcugacaucugcaguuuuagaggggucacaucaacugaaguagaugcaacugacagccccaggguggcagggucacauagaauuaugguacagcuuagggagccagauggagaggaguuuucacccacaggucccaacccugccccuguuggcaccccagacuuucaagcagccauauuuggcacccucagucaaagaaacacugguggagcugggcagaauucuaacagagcccacuucgcauauuucuacacaagaaaccccaccuuugcaccaggcauagggacuguuguauuuucuuuugacaccacugauuuucaaaaucgucaaccuaccaaauuuuccccuucugguguguuugaugaugauucuucugaaccuuucaaucaguuuucccugccauauuauaauggaucacucggugcaguggacgcuggaaaacuggcuccaccuguggcacccaauuauccaggugagcagauucuuuauuucagagggaguguaccuuucaaaggugguuauggagaaggugagauugacaguuugcuuccccaggaauggauuacccauuucuaugcagagcaggcccccacacaaggugacgcagcccugcugcgcuacuacaacccugacacugguagaguccucuuugagugcaaacuccaucgugaaggauucaucacaaucaacuacacgggauccaaugcucuugcugugccggucaauggagucuucagguuugagggcuggguuaacaaauucuacacacugacccccauguaa

SEQ ID NO: 6874 - RNA, 1629 nt, Artificial Sequence
  VP1__Norovirus_and/or_Norovirus-like__GQ856474
augaggauggcgucgagugacgcgcccguuucuggcaccgauggugcggcaggacucguuccagagagucaacaagaagucuugccuuuagagcccgucgcgggaguucagcuggcugcucccguagcagggcaaaguaauauaauugaccccuggauuagaaugaauuuugugcaagccccggccggugaguucacuguguccccucgggacgcaccgggugagguacuuauugauuuagaauuaggaccagaauuaaaucccuaucuuaaucaccuugcaagaauguauaauggguauguaggaggaauggagguggaaguuguccuugccgggaaugcguucacggcggguaagaucuuauucgcagcugugccccccagcuucccaacccauggcaucucugcagcacaggcaacuauguugccacaugugauuguggaugucaggcagcuggagccuguucggcucccucucccugaugucaggaaugugauguuccauuucugucaagagaauaaggagccgcgcaugagaauuguggcaauauuguacaccccccuccgugcuaacggugcgggugacgauguuuucacugucucaugucgugugcuaacaagacccucaccagauuuugauuuuauuuucuuaguccuccccucuguagagaguaaguugaaacaguuuacccucccaaaucugcagccaaaugagaugaccaauucgagauuccccacugguauuauacagcuuuacaccaguccaaacaccaauuugguuguccaguuccaaaauggcaggugucuacuugauggcacacuucuugguaccaccccugucagagcugcugacaucugcaguuuuagaggggucacaucaacugaaguugaugcaacugacagucccagaguggcagggucacauagaauuauggugcagcuuaaggagccagauggagaggaguuuucacccacaggucccaacccugccccuguuggcacuccagacuuucaagcagccauauuuggcacccuuagucaaagaaauacuggcggggcugggcagaacuccaacagagcccgcuucgcauacuucuauacuagaaacccuacauucgcaccaggcauagggacaguuguauuuucuuuugacaccacugauuuucagaaucgccaaccuaccaaauucucuccuucugguguguuugaugaugacucuucugaaccuuucaaucaauuuucucuaccauauuauaauggaucacucggugcaguggaugcugggaaacuggcuccgccuguggcacccaauuauccaggugagcagauucuuuauuucagagggaauauacccuucaaagguggguauggagagggugaaauugauagcuugcuuccccaggaauggaucacccacuuuuaugcagagcaggcccccacacaaggugacgcagcccugcugcgcuacuacaacccugacacuggcagaguccucuuugagugcaaacuccaccgcgagggauucaucacaaucaauuacacaggauccaaugcucuugcuguaccagucaauggagucuucagguuugagggcuggguuaacaaauucuacacacugacccccauguaa

SEQ ID NO: 6875 - RNA, 1629 nt, Artificial Sequence
  VP1__Norovirus_and/or_Norovirus-like__LC145787
augaagauggcgucgaaugacgccgcuccaucuacugauggugcagccggccucgugccagaaaguaacaaugaggucauggcucuugaacccguggcuggugccgccuuggcagcaccggucaccggucaaacaaauauuauagacccuuggauuagagcaaauuuuguccaggcccccaauggcgaauuuacagucucuccccguaaugccccuggugaagugcuauuaagucuagaauuggguccagaauuaaauccuuaucuggcacauuuagcaagaauguacaacggguaugccggugggauggaggugcaggucauguuggcugggaaugcguucacagccggcaaguuggucuucgccgcugugccaccucacuucccgguugaaaaccuuagcccacagcaaauuaccauguucccucaugugauuauagauguaaggaccuuggaaccuguuuuauuaccacucccugauguuaggaauaauuucuuccauuauaaucagaaagaugaucccaaaaugagaauuguggcuaugcuuuauaccccccuuagaucuaaugguucaggugaugauguguucacaguuuccugcaggguguugaccagacccuccccugauuucgauuucacauaucuggugccaccaacaguggaaucuaaaacaaaaccauucacccucccaauccucacacuuggggaacuuuccaauucuagguucccaguguccauagaccagauguacaccagcccuaaugaaguuauaucagugcagugucaaaaugguaggugcacauuggacggggaacuucaagggacaacacaacuccaagucaguggcauuugugcuuucaagggggaagugaccgcccauuugcaugacaaugaucaccuauacaaugucaccaucacaaacuugaauggguccccuuuugaccccuccgaggacguuccugccccucugggcgugccugauuuccagggaagggucuuugguauuaucucccaaagagacaaacauaauagcccugggcauaaugaaccagcaaacaggggacacgacgcuguggucccuacuuacacagcacaguacacuccaaaauugggucagauucaaauuggcacauggcagaccgaugaucuuacagucaaccaaccagucaaauucaccccaguuggacucaaugacacugaacauuuuaaucaaugggugguccccagauacgcuggugcccuaaaccucaacacaaaccuugccccuucuguugcuccgguauuuccaggggagcgccugcuuuucuucagaucauacguuccccucaagggugguuauggaaauccagccauugauugccuauuaccacaagagugggugcaacacuucuaucaggaagcugccccaucaaugagugagguggcccuugucagauacaucaacccggauacuggucgggcacuguuugaggccaagcuccacagagcugguuucaugacagucucgagcaacaccagugccccggugguugugccugccaauggguacuucagauuugacucuuggguuaaucaauucuauucucucgcccccaugggaacuggaaaugggcguagaaggguucaauaa

SEQ ID NO: 6876 - RNA, 1629 nt, Artificial Sequence
  VP1__Norovirus_and/or_Norovirus-like__AB629946
augaagauggcgucgaaugacgccgcuccaucuacugauggugcagccggccucgugccagaaaguaacaaugaggucauggcucuugaacccguggcuggugccgccuuggcagcaccggucaccggucaaacaaauauuauagacccuuggauuagagcaaauuuuguccaggcccccaauggcgaauuuacagucucuccccguaaugccccuggugaagugcuauuaagucuagaauuggguccagaauuaaauccuuaucuggcacauuuagcaagaauguacaacggguaugccggugggauggaggugcaggucauguuggcugggaaugcguucacagccggcaaguuggucuucgccgcugugccaccucacuucccgguugaaaaccuuagcccacagcaaauuaccauguucccucaugugauuauagauguaaggaccuuggaaccuguuuuauuaccacucccugauguuaggaauaauuucuuccauuauaaucagaaagaugaucccaaaaugagaauuguggcuaugcuuuauaccccccuuagaucuaaugguucaggugaugauguguucacaguuuccugcaggguguugaccagacccuccccugauuucgauuucacauaucuggugccaccaacaguggaaucuaaaacaaaaccauucacccucccaauccucacacuuggggaacuuuccaauucuagguucacaguguccauagaccagauguacaccagccuuaaugaaguuauaucagugcagugucaaaaugggaggugcacauuggacggggaacuucgagggacaacacaacuccaagucaguggcauuugugcuuucaagggggaagugaccgcccaugugcaugacaaugaucaccuauacaaugucaccaucacaaacuugaauggguccccuuuugaccccuccgaggacguuccugccccucugggcgugccugauuuccagggaagggucuuugguauuaucucccaaagagacaaacauaauagcccugggcauaaugaaccagcaaacaggggacacgacgcuguggucccuacuuacacagcacaguacacuccaaaauugggucagauucaaauuggcacauggcagaccgaugaucuuacagucaaccaaccagucaaauucaccccaguuggacucaaugacacugaacauuuuaaucagugggugguccccagauacgcuggugcccuaaaccucaacacaaaccuugccccuucuguugcuccgguauuuccaggggagcgccugcuuuucuucagaucauacguuccccucaagggugguuauggaaauccagccauugauugcuuauuaccacaagagugggugcaacacuucuaucaggaagcugccccaucaaugagugagguggcccuugucagauacaucaacccggauacuggucgggcacuguuugaggccaagcuccacagagcugguuucaugacagucucgagcaacaccagugccccggugguugugccugccaauggguacuucagauuugacucuuggguuaaucaauucuauucucucgcccccaugggaacuggaaaugggcguagaaggguucaauaa

SEQ ID NO: 6877 - RNA, 1629 nt, Artificial Sequence
  VP1__Norovirus_and/or_Norovirus-like__KT962983
augaagauggcgucgaaugacgccgcuccaucuacugauggugcagccggccucgugccagaaaguaauacugaggucauggcucuugaacccguggcuggugccgcuuuggcagccccagucacuggucaaacaaauauuauagacccuuggauuagagcaaauuuuguccaggcccccaauggugaauuuacagucuccccccguaaugccccuggugaagugcuacuaaaucuggaguuggguccagaauuaaauccuuaucuggcacacuuagcaagaauguacaacggguaugccggugggauggaggugcaggucauguuggcugggaacgcguucacagccggcaaguuggucuucgccgccgugccaccucacuucccgguugaaaaccuuaguccacaacaaauuaccauguucccucaugugauuauagauguaaggacuuuggaaccugucuuauuaccacucccugauguuagaaauaauuucuuucauuacaaucagaaagaugaucccaagaugagaauuguggcuaugcuuuauaccccccuuagaucaaauggcucaggugaugauguguucacagucuccuguaggguguuaacuaggcccuccccugacuuugacuucacauaucuggugccaccaacaguggagucuaaaacaaaaccauucacccucccaauccucacacuuggggaacuuuccaauuccagauucccagugucuauagaccagauguacaccagcccuaaugaaguuauaucagugcagugucaaaaugguaggugcacauuggacggggagcuccaagggacaacacaacuccaggucaguggcauuugugcuuucaagggagaggugaccgcccacuugcaugacaaugaucaccuauacaauaucaccaucacaaacuugaauggauccccuuuugaccccucugaggacaucccugccccucugggcguaccugacuuucagggaagggucuuugguauuaucucccaaagggacaaacacaauagcccuggacauaaugaaccagcaaacaggggacacgacgcuguggucccuacuuacacagcacaguauacuccaaaauugggucagauucaaauuggcacauggcagacugacgaucucacugucaaccaaccaguaaaauucaccccaguuggacucaaugauacugaacauuuuaaccaaugggugguccccagauaugcuggugcccuaaaccucaacacaaaccuugccccuucuguugccccaguauuuccaggggagcgccugcucuuuuucagaucauacaucccccucaaggguggcuauggaaauccagccauugauugccuacuaccacaagagugggugcaacacuucuaccaggaagcagccccuucaaugagugagguggcccuugucagguacaucaacccggacacuggucgggcacuguuugaggccaagcuccacagagcugguuucaugacggucucaaguaacaccagugccccggugguuguaccugccaauggauacuucagguuugacucuugggugaaccaauuuuauucucucgcccccaugggaacuggaaaugggcguagaaggguucaauaa

SEQ ID NO: 6878 - RNA, 1626 nt, Artificial Sequence
  VP1__Norovirus_and/or_Norovirus-like__AB083780
augaagauggcgucgaaugacgcugcuccaucuaaugauggcgcugccggccucguuccagagaucaacacagagguuauggcacuggagccaguugcuggaggagcuaucgcagccccucucacuggacaaacaaauauaauugaucccuggauuagaaauaauuuugugcaagccccaaauggugaauucaccauaucuccuagaaacuccccaggggaaauccuguuaaauauggaauuaggaccugaguugaacccuuucuuggcucaccucuccagaauguacaaugguuuugcaggugguauggagguacagguauugauggcggggaaugcuuucaccgcuggaaaggucaucuuugcugcaguuccaccccauuuuccaguggagaauuuaagccccccccaaauaacuauguucccucauauaauuauagauguuaggacccuagaaccagucuuguugcccaugcccgaugugagaaaucaauucuuccauuacaaucaggugaacgaacccaggaugcgguuaguggccaugcucuacacacccuugagaucaaacggauccacugaagacguuuucacgguguccugcaggguguugaccaggccuucaccggauuuugaguucaauuaccuggugcccccaacuguggagucaagaacaaaacccuucaccuuaccuguccucacaauuggagagaugacaaauucacgcuuccccgcacccauagauaugcuuuacacuagccccaaugguaauguaguuguacaaccacaaaaugguagaugcacccuugauggugagcuucagggaagcacacaacuagucccagcaaaugugugugcauuuagagguaaaaucacagcaaggaucguugaucaggcagcacaccaguggcauaugcagauugacaaucccaaugggacacucuuugauccaacugaggaugugccugcaccccuuggaaccccugacuucaaagccaagauauucggggucauaucucaaaggaaugauuacaaugaugguagucagggaccugcaaacagagcacaugaugccgugguacccaccacgucagcuaaauucaccccaaaauuggguuccauauuggugggcacuugggagaauaaugacauagaaacacagccuuccaaauucacuccaguuggccugcucgagaugaaugacuucaaucaguggucacuuccaaauuauucaggggcccuaacccucaauaugggccuugcaccagcggucuucccaacuuucccuggugagcagauucuuuucuucagaucuuuuaucccacuuaaaggcggccacggcaauccagccaucgacugccuucucccgcaagaguggauacagcacuucuaccaggagucugcccccucccaaaccaguguugcucugauuagguauguaaacccugauacaggacgaguccuguuugagggaaaguugcauaggcagggauucauaaccauugcaaagucaggagauggaccaauuguugugcccccaaauggauauuuuagguuugacucuugggugaaucaauuuuacucacuugcccccaugggaaacggaaacgggcgcagaaggauccaguaa

SEQ ID NO: 6879 - RNA, 1626 nt, Artificial Sequence
  VP1__Norovirus_and/or_Norovirus-like__KX987840
augaggaugagugauggcgcagcgccaaaagccaacggcucugaagccagcggccaggaucuuguuccuaccgccguugaacaggccguccccauucagcccguggcuggcgcggcucuugccgcccccgccgccgggcaaaucaaccaaauugaccccuggaucuuccaaaauuuuguccaaugcccccuuggugaguuuuccauuucaccucgaaacaccccaggugaaauauuguuugaucuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaauugccucuucuugacgugcgucgaguucuuuggcaugcuacccaggaucaggaggaaucuaugcgccuggucugcauguuguacacgccacuccgcacaaacagcccgggugaugagucuuuuguggucucuggccgccuucuuucuaagccggcggcugauuucaacuuuguauaccugaccccccccauagagagaaccauuuaccggauggccgacuugcccgugauacagccgcggcugugcacgcacgcacguuggccugccccggucuauggccucuugguagacccaucccuucccucaaacccccaguggcaaaauggaagagugcauguugaugggacccugcuuggcaccaccccaaucucuggcucguggguguccugcuucgcggcagaggcugccuaugaguaccagucaggcacgggcgagguggcaacguucacccugauugaacaagauggcucugcuuauguccccggugacagggcagcgccgcucggcuaccccgauuucuccgggcaacuggagauugagguccaaaccgagaccaccaagccuggagacaagcucaagguuaccacuuuugagaugauacugggcccaacgaccaacguggaucaggccccuuaccagggcaggguguacgcuagcgucacugcugcggcaacccuuaaccugguggacggcaggguucgcgcggucccaagguccaucuauggcuuccaagauguuaucccugaauacaaugaugggcuacuagucccccuugcccccccaauuggucccuuucuuccuggcgagguccuuuugagguuccgaaccuacaugcgucagauugacagcuccgacgcugcggcagaggcgauagacugugcacucccucaggaguuuaucucuugguucgcguccaacgcguuuaccgugcagucugaagcccugcuccuuagguacaggaacacccugacugggcagcugcuguuugagugcaaacucuacagcgaggguuauaucgccuugucuuacccaggaucaggaccccucaccuucccaacugauggcuucuuugaagucguuagcugggucccccgccuuuaucaauuggccucugugggaagcuuggcaacaggccgaacacucaagcaauaa

SEQ ID NO: 6880 - RNA, 1626 nt, Artificial Sequence
  VP1__Norovirus_and/or_Norovirus-like__KR349276
augaggaugagugauggcgcagcgccaaaagccaacggcucugaagccaacggccaggaucuuguuccuaccgccguugaacaggccguccccauucagcccguggcuggcgcgucucuugccgcccccgccgccgggcaaauuaaccaaauugaccccuggaucuuccaaaauuuuguccaaugcccccuuggugaguuuuccauuucaccucgaaacaccccaggugaaauacuguuugauuuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcguacccuggagcccauucaacucccucuucuugacgugcgucgaguucuuuggcaugcuacccaggaucaggaggaaucuaugcgccuggucugcaugcuguacacgccacuccgcacaaacagcccgggugaugagucuuuuguggucucuggccgccuucuuucuaagccggcagcugauuucaacuuuguauaccugaccccccccauugagaggaccauuuaucgaauggucgacuugcccgugcuccagccgcggcugugcacgcacgcucguuggccagcaccggucuauggucucuugguggauccaucccucggguccaacccccaauggcagaauggaagagugcauguugaugggacccuccuuggaacaacacccaucucugggucuugggucuccuuguuugcagccgaggccgccuacgaguuccagucuggaacuggugagguggcgaccuucacccugauugagcaggacggauccgcuuacgucccuggugagagagcggccccccucgguuaucccgauuucucugggcagcuggagauugagguccagaccgagaccaccaagacaggugacaaguugaagguaaccaccuuugagaugauccuuggucccaccaccaacguggaccaggcgcccuaucagggcaggguguacgccagucuaacgacugcggccucccuugaucugguggauggcaggguuagagcggucccacgcucuaucuauggcuuucaggaugugaucccugaauauaaugauggucuucuugucccccuugcccccccuauuggccccuuucucccuggugaggugcuccugagguuccggaccuacaugcgccagaucgacagcucugacgccgcagcggaggccauugacugcgcccuuccacaggaauucgucucgugguuugcgaguaacgcauucacagugcagucggaggcucugcuccuuagguacaggaauacccugacugggcaacugcuguuugagugcaagcucuacagcgaaggcuacaucgcccuguccuauucgggcucaggaccacucacuuucccgacugauggcuucuuugaggucgucagcuggggcccccgccuuuaucaauuggccucugugggaagcuuggcaacaggccgaacacucaaacaauaa

SEQ ID NO: 6881 - RNA, 1626 nt, Artificial Sequence
  VP1__Norovirus_and/or_Norovirus-like__KM102449
augaggaugagugauggcgcagcgccaaaagccaacggcucugaagccaucggccaggaucuuguuccuaccgccguugaacaggccguccccauucagcccguggcuggcgcggcucuugccgcccccgccgccgggcaaaucaaccaaauugaccccuggaucuuccaaaauuuuguccaaugcccccuuggugaguuuuccauuucaccucgaaacaccccaggugagauacuguuugauuuggcccucgggccagggcuuaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcgcccuggagcccauucaacucccucuucuugaugugcgucgaguucuuuggcaugcuacccaggaucaggaggaaucuaugcgccugguuugcaugcuguacacgccacuccgcacaaacagcccgggugaugagucuuuuguggucucuggccgccuucuuucuaagccggcagcugauuucaacuuuguauaccuaaccccucccauugagaggaccguuuaccggauggucgaccugcccgugcuacagccgcggcuguguacgcaugcucguuggccugccccggucuauggccucuugguagauccuucccucccauccaacccucaguggcagaauggcagagugcaugucaacgggacucuucuuggcacgacaccugugucuggcuccugggucuccugcuuugcagcugaggccgccuacgaguuccaguccgggacuggcgagguggcgaccuucaccaugauugagcaggaugggucugccuauguccccggugauagggcggcuccccucggguaucccgacuucuccgggcaacuggagaucgaggugcagacugagaccaccaagucaggagauaaacucaaggugaccacuuuugagaugauccucgguccaaccaccaacgcggaccaagcccccuaccagggcaaaguauacgcaagccuagcggcugcggccccgcucgaccugguggacgggaggguuagggcgguuccacgcucugucuauuucuuucaggaugugcucccagaguacaaugauggucuuuuaguuccccuugccccgccccuaggccccuuccuccccggugaggucuuguugagguuccggaccuacgugcgucagcuggacaccgcugacgccgcagcgcagccgaucgacugugccuugccccaggaguuuaucuccugguuugcaagcaacagcuucacgguucagucggaagcgcuccugaucagauaccggaacaccuugaccggccagcuccuguuugaggcuaagcucuauagcgaaggcuacauugcuguguccuacucgggaucugguccccucaccuucccuacugauggcuucuuugaggucgucagcugggucccccgccuuuuccaauuggccucugugggaagcuuggcaacaggccgaacacucaaacaauaa

SEQ ID NO: 6882 - RNA, 1626 nt, Artificial Sequence
  VP1__Norovirus_and/or_Norovirus-like__KC792553
augaggaugagugauggcgcagcgccaaaagccaacggcucugaagccagcggccaggaucuuguuccuaccgccguugaacaggccguccccauucagcccguggcuggcgcggcucuugccgcccccgccgccgggcaaaucaaccagauugacccauggaucuuccaaaauuuuguccaaugcccccuuggugaguuuuccauuucaccccgaaacaccccaggugaaauacuguuugauuuggcccucggaccggggcucaaccccuaccucgcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacuuccccuucuugacgugcgucgaguucuuuggcaugcuacccaggaucaggaggaaucuaugcgccugguuugcauguuguacacgccacuccgcacaaacagcccgggugaugagucuuuuguggucucuggccgccuucuuucuaagccggcggcugauuucaacuuuguauaccugaccccccccaucgagaggaccaucuaccgaauggucgaccugcccguguugcagccgcggcugugcacgcacgcucguuggccagccccggucuauggccucuugguugacccgucccucccguccaacccccaauggcagaauggaagagugcacguugauggaacccuucuuggcacaacaccugucucugguuccuggguuuccugcuuugcagcagaagccgccuacgaguuccagucugggauuggucagguggcgaccuucaccaugauugagcaggacgggucugccuacgucccuggugacagggcggccccccuuggcuaccccgauuacuccgggcaacuggagauugaggugcagacugagaccaccaaagcaggugacaagcugaaagugaccaccuuugagaugauccuuggucccacuaccaacgcggaccaggcucccuaccaggguagagcguaugcgagcuuaacggcugcagccucacucgaccugguagacgggaggguuagggcggucccccgcucuaucuacuccuuccaggacgugcucccagaguacaaugauggucuuuuggucccccuugccccaccccugggucccuuccuucccggugaggucuuguugagguuccgaaccuacaugcgccagcuugacaccgcugacgccgcagcgcagccgauugacugugccuugccccaggaguucgucucuugguucgcaagcaacagcuucacgguccagucggacgcgcuccugguuagguaccggaacaccuugaccggccagcuccuguucgaggcuaagcucuauagugaaggcuauauugcugugucuuauucaggaucuggcccccucacuuuucccgccgacggcaucuucgaggucguuaguugggucccccgccucuuucaauuggccucugugggaagcuuggcaacaggccgaacacucaaacaauaa

SEQ ID NO: 6883 - RNA, 1626 nt, Artificial Sequence
  VP1__Norovirus_and/or_Norovirus-like__AB809991
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuaguccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcaggggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgcccccaugggaacuggcaaugggcguagaagaguuuaa

SEQ ID NO: 6884 - RNA, 1626 nt, Artificial Sequence
  VP1__Norovirus_and/or_Norovirus-like__AB809990
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcagucugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaagagugggugaaucacuuuuaucaagaggcugcucccucucaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgcccccaugggaacuggcaaugggcguagaagagucuaa

SEQ ID NO: 6885 - RNA, 1626 nt, Artificial Sequence
  VP1__Norovirus_and/or_Norovirus-like__AB809977
augaagauggcgucgaaugacgccgcuccaucaaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauuuuauuaaauuuagaguuaggaccggauuuaaauccuuauuuggcccacuuaucaagaauguacaaugguuaugcuggagguguugaggugcaagugcuccuugcugggaacgcguucacagcaggcaagauacuauuugcagcaaucccacccaacuuuccuguagauaugauuagcccagcucaaaucacuaugcuuccccacuugauuguagauguuaggacuuuggagccuauuaugauacccuuaccugauguuaggaauguguuuuaucauuuuaacaaucaaccucagccuaggaugagacuaguggcuaugcucuacaccccauugagaucuaaugguucaggagaugaugucuuuacugugucuuguagagugcugacuaggccaaccccugacuuugaauucauuuaccuagugccccccucuguggaguccaagacuaaaccauucacacuuccaauauugaccauuucugagcuaaccaacucccgguuccccaucccaauugagcaacuguacacggccccaaaugagaauaauguuguacagugucaaaauggcaggugcaccuuggauggagagcuucagggcaccacccagcugcuaucaagugcaguuugcucuuacaggggaaggacuguggccaacaguggagacaauugggaccagaacuugcuccagcugaccuacccaaguggugcaagcuaugaccccacugacgaaguaccagcacccuugggcacccaggauuucagugguauauuguaugggguguuaacccaagacaauguuagugagagaacaggggaggccaaaaaugccaagggaauauacauaucuaccaccaguggaaaauucaccccaaaaauugguucaauaggauugcauucaauaacugaaaaugugcaccccaaucaacaaucacgguucacccccguuggagucgcucagaaugagaacacccccuuccaacaauggguccuaccacacuacgcaggugcucucgcucuaaacaccaauuuggcacccgcuguugccccgacuuucccuggugagcaauuacuguucuucaggucccguguuccauguguacaaggccugcaggggcaggaugcuuucauagauugucuccugccccaagagugggugaaucauuuuuaucaagaggcugcuccuucccaagcagacguugcccuuaucagguaugucaacccugauacuggucgcacgcuguuugaggccaaauugcauagaucagguuuuauuacugugucacauacuggugccuacccucuuguggucccuccaaauggccauuucagguuugacucuuggguuaaccaauucuacucacucgcccccaugggaacuggcaaugggcguagaagaguuuaa

SEQ ID NO: 6886 - RNA, 1626 nt, Artificial Sequence
  VP1__Norovirus_and/or_Norovirus-like__AB809987
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguaugggguguuaauccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacuagcccccaugggaacuggcaaugggcguagaagagucuaa

SEQ ID NO: 6887 - RNA, 1626 nt, Artificial Sequence
  VP1__Norovirus_and/or_Norovirus-like__AJ844469
augaugauggcgucuaaagacgccccuucaaacauggacggcacuaguggugcuggucagcugguaccagaggcaaacacagcugauccuauccccuuagaaccuguagugggggcugcaacugcagccgccacagcaggccaaguuaauaugauugaccccuggauuaugaauaauuuugugcaaucaccagaaggcgaguuuacaauuuccccaaacaacacgccuggugauauuuuguuugaucuacaauugggcccccacuugaauccauuucugcagcaccuaucacaaauguauaaugguuggguuggcaacaugaggguuagaauuuugcuggcagggaaugcguuuucugcugguaagauaauaaucuguugugugccaccuggcuuuacugcucagaauaucucuauugcccaagcuacaauguuuccacaugucaucgcugauguucgaguucuagagccuauugaaaucccccuugaugauguuaggaaugugcuuuuccauacaaaugagaacaaacccacaaugcgcuuguuauguaugcucuacaccccauugcgggccggaggcgcgucugcagguacagauccauucguaauugcaggucgcgucuuaacgugcccuuccccagauuucaauuucuuguuucuaguccccccuaguguggaacagaaaacuaggcaauuaacuguccccaauaucccauuaaauaaucugucaaauucuagagugcccgccaugaucaguaagauggcuaucuccucagaugcuaaucagguuguccaauuccaaaauggcaggugcaccacagaugggcaguuguugggcacaacaccaauuucugcaagucaaguggcccgcauccgcgguaaggucuucuccaccucaucugguaaaggauugaaucuaucugagcuggauggcaguccguaccacgccuuugaaagccccgccccaguugguuucccugaucuuggguauugugauuggcauguuucuuccuucaaggcagaccacaauucuagcagugaucccauuucacguuuggauauaaaacaaggggcuuccuuugccccacaccuggguucuauugaauacaccacuucgcaaaacccagauggugaucaguuaggcacucuaaccuggaucucguccccaucagaugacacacccggccauggcacaauuaaccuauggaagaucccuuccuauggcuccacagucacugagucaguccaucuugcacccccaauauacccuccaggguuuggggaaacacuuguuuauuucaugucugacuuuccaauuggacacacuaauuccaauauggcacaagugccauguacccucccucaagaauuuguggcacacuuuguuaaugagcaggccccuguucgaggggacgcagcauugcuccacuauguggacccugacacacacagaaaucuuggugaauucaaguuauacccugaggguuacauaaccugcgugccaaacacggguggugguggcccccaaagccucccaaucaacggaguguuuauuuucucauccuggguaucuagguauuaucaacuuaagccugugggaacagcugggccagcuaggaggcuuuaa

SEQ ID NO: 6888 - RNA, 1626 nt, Artificial Sequence
  VP1__Norovirus_and/or_Norovirus-like__AY675555
augaagauggcgucuaaggacgccccuucaaacauggacggcaccaguggugcuggucagcugguaccagaggcaaacacagcugauccuauucccuuagaaccuguaguaggggcugcaacugcagccgccacggcaggucaaguuaauaugauugaccccuggauuaugaauaauuuuguacagucgccagaaggcgaguucacaauuuccccaaacaacacgccuggugauauuuuguuugauuuacaauugggcccccauuugaauccauuucugcagcaccuaucacaaauguacaauggcuggguuggcaacaugaggguuaggauuuugcuggcagggaaugcguuuucugcugguaagauaauaauuuguugugugccaccuggcuucacugcccagaauaucucuauugcucaggccacaauguuuccacaugucauugcugauguucgaguucuggagccuauugaaaucccccuugaugauguucggaacgugcuuuuucauacaaaugagaacagacccacaaugcgcuuguugugcaugcucuacaccccauugcgggccggaggcgccucugcagguacagauccauucguaauugcaggucgcgucuuaacgugccccucuccagauuuuaauuucuuguuucuaguccccccuaguguagagcagaaaaccagacaauuaacuguccccaauaucccauuaaacaaucugucaaauucuagugugccugccaugauuaauaagauggcuaucuccucagaugcuaaucagguuguccaguuccaaaauggcaggugcaccacagauggucaguuguuaggcacaaccccaaucucugcgagucaaguggcccgcauccguggcaaggucuucuccacuucgucaggcaaaggacugaaucugucugagcuggauggcagcccguaccaugccuuugaaagccccgcuccaguugguuuuccggaucuuggacauugugauuggcaugucucuuccuucaaggcagaucaaaauucuaguggugaucccauuucacgcuuggauauaaaacaaggggcuuccuuugccccacaccuggguucuauugaauacaccacuucacaaaacccagaugguggucaauuaggcacccuaaccuggaucucauccccaucagaugacacgcccggccauggcacaaucaaccuauggaagaucccuuccuauggcuccacagucacugaaucuguccaucuugcacccccaauauacccuccaggguuuggggagacacuuguuaauuuaaugucuaacuuuccaauugggcauacuaauuccaauauggcacaagugccauguacccucccucaagaauuuguggcacacuuugucaaugagcaggcuccuguucgaggggacgcagcauugcuccacuauguggacccugacacacacagaaaucuuggugaguucaaauuauacccugaaggcuacauaaccugugugccaaacacugguggugguggcccccaaagucucccaaccaauggaguauucauauucucaucuuggguaucuagguauuaucaacuugagccugugggaacagcuggaccagcuaggaggcuuuaa

SEQ ID NO: 6889 - RNA, 1626 nt, Artificial Sequence
  VP1__Norovirus_and/or_Norovirus-like__EU085479
augaagauggcgucgagugacgccacuccaucuaaugauggugccgccggccucgucccagagaucaacaaugaggcaauggcgcuagauccaguggcgggugcagcgauagcagcaccccucacuggucagcaaaauauaauugaucccuggauuaugaauaauuuugugcaagcaccugguggugaguuuacuguguccccuaggaauuccccuggugaagugcuucuuaauuuggaauugggcccagaaauaaaucccuauuuggcccaucuugcuagaauguauaaugguuaugcagguggauuugaagugcagguaguccuagcuggaaaugcguuuacagcaggaaagauaaucuuugcagcuauacccccuaauuuuccaauugauaauuuaagcgcagcacagaucacaaugugcccacaugugaucguggaugucagacaauuggaaccggucaaccuuccgaugccugacguucgcaauaacuucuuucacuacaaucaagggucugauucgagauugcgcuuaauugcaaugcuguacacaccucucagggcaaauaauucuggggaugauguuuuuacugugucuuguagagugcugaccaggccuagcccugacuuuucauuuaauuuucuugugccaccuacuguggagucaaagacaaaacccuucacccucccuauucugacuaucucugaaaugucuaauucuagguuuccagugccgauugauucucugcacaccagcccaacugagaauauuguuguccagugccaaaaugggcgcgucacucuugauggugaguugaugggcaccacccaacucuuaccuagucaaaucugugcuuucaggggcgugcucaccagaucaacaagcaggaccagugaucaggccgauacagcaaccccuagauuguuuaauuauuauuggcauauacaguuggauaaucuaaaugggacuccuuaugauccugcagaagacauaccaggcccccuagggacaccagauuuccggggcaaagucuuuggcguggccagccagagaaaucccgacagcacaacuagagcacaugaggcaaagguggacacaacagcuggucguuucaccccaaaacuaggcucauuagagauauccacugaaucuagugacuuugaucaaaaucaaccaacaagauucaccccaguuggcauugggguugaccaugagacagacuuucaacaauggucuuuacccgacuacucuggucaguucacccacaacaugaacuuagccccagcuguugcucccaacuuuccuggugagcagcuccuuuucuuccgcucacagcuaccauccucuggugggcgauccaacgggauucuagauugccuggucccccaagaauggguucagcacuucuaccaagaaucggcccccgcccaaacgcaaguggcccugguuagguaugucaacccugacacugguagaguauuauuugaagccaagcugcacaaauuagguuuuaugaccauagccaaaaauggugacucuccaauaacugucccuccaaauggguacuuuagguuugaaucuugggugaaccccuuuuauacacuugcccccaugggaucuggauaa

SEQ ID NO: 6890 - RNA, 1626 nt, Artificial Sequence
  VP1__Norovirus_and/or_Norovirus-like__AF542090
auggcgucuaaggacgcgcccguuucuggcaccgauggugcggcaggacucgucccagagagucaacaagaagucuugccuuuagagcccgucgcgggaguucagcuggcugcucccguugcagggcaaaguaauauaauugaccccuggauuagaaugaauuuuguacaagcuccggccggugaguucacuguguccccucggaacgcgccgggugaggugcuuauugauuuagaauuaggaccagaauuaaaucccuaccuuaaucaccuugcaagaauguauaauggguaugugggaggaauggagguggaaguuguccuugccgggaaugcguucacggcggguaaggucuuguuugcagcugugccccccagcuucccaacccauggcaucacugcagcacaggcaaccauguugccacaugugauuguggaugucaggcaauuggagcccguccggcucccucucccugacgucaggaaugugauguuccauuucugucaagagaauaaggagccgcgcaugagaaucguggcaauauuguacaccccacuccgagccaacggugcgggugaugauguuuucacugucucaugucgugugcuaacaagacccucaccagauuuugauuuuauuuucuuggucccccccuccguagagaguaaguuaaaacaguuuacccucccaaaucugcagccaaaugagaugaccaauucaagauuccccacuaguguuacacaacucuacaccaguccaaacaccaauuugguuguccaguuccaaaaugguaggugucagcuugauggcacacuccucggcaccaccccugucagagcugcugacaucugcaguuuuagagggaucacgucagcugaaguugauacaacugacagcuccagaguggcagggucacacagaguuaugguacaacuuaaggagccagauggagaggaguuuucacccacaggucccaacccugccccuguuggcacuccagacuuccaagcagccauauuuggcacucucagucaaagaaacaacacuggcggaucuggccagaauuccaacagaucccacuucgcauacuuuuacacaagaaaccccacauuugcaccaggcauagggacaguuguauuuucuuuugacacuacugauuuccaaaaucgccaaccuacuaaauuuucuccuucugguguguaugaugaugauucuucugagcccuuuaaucaguucucccugccauauuacaaugggucacucggugcaguggacgcugggaaacuggcuccgccuguggcacccaauuauccaggugagcagauucuuuauuuuagagggaauauaccuuucaaagguggguauggaggaggugaaauugacugcuuacuuccccaggaauggaucacccaccuuuaugcagagcaggcccccacacaaggugacgcagcccuucugcguuacuacaacccugauacuggaagaguccucuuugagugcaaacuccaccgcgagggauucaucacaaucaauuauacaggauccaaugcucuugcuguaccagucaauggagucuucagguucgagggcuggguuaacaaauucuacacauugacccccauguaa

SEQ ID NO: 6891 - RNA, 1623 nt, Artificial Sequence
  VP1__Norovirus_and/or_Norovirus-like__KM386680
augaagauggcgucgaaugacgcuacuccaucaaaugauggugcugccggccucgugccagaaaguaacaaugaggcaauggcucuggaacccguggugggggcgucuuuagccgccccugucacuggccaaacuaauauaauagaccccuggauuagaacuaauuuuguccaagcccccaauggugaauucacaguuuccccuagaaauuccccuggagagauauuggucaauuuggaguuagguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagcccuccccaaauaacaauguucccacaugugauuaucgauguuagaaccuuagaaccuguacugcucccaaugccugaugucagaagcacccuuuuccacuuuaaucaaaaggaugaaccuaagaugagacuuguugccaugcuuuacaccccucuucguucuaauggcucuggugaugacguuuucacugucucauguaggauccucacuaggcccuccccugaauuugauuucacauacuuggugccaccaacaguggagucaaagaccaagccauucacacuaccugugcugacacugggagaauuguccaauucuagauucccucucucuauugaugaaauggucaccagcccuaaugaguccauaguuguucagccacagaaugguagggucacacuagauggggaguuguuaggcacgacccaacugcaagcauguaacauuuguuccauaagggggaaagugacaggacaggucccuaaugaacaacacauguggaaccuggagauuacaaaccuaaaugggacgcaauuugacccuacagaugaugucccagccccucuuggugugcccgacuuugcaggugaggucuuugguguacucagccagagaaauagaggugaaagcaauccagcaaacagggcucaugaugcugucguggcuaccuacagugauaaauacaccccuaaauugggcuuagugcaaauugggacuuggaacaccaacgauguugaaaaccagccaacaaaauucaccccaauugguuugaaugaggucgccaauggccaucgauuugaacaguggacuuugccuagguauucuggcgcccugacauuaaauaugaauuuagcuccugcuguggccccgcucuuuccuggagagcgucuccuuuucuuccgcucuuacgucccauuaaaagguggauuuggaaacccugcuauagauugucuagugccucaggaguggguccaacauuucuaucaggaaucugccccaucucugggggauguggccuuagucagguacgucaacccagacaccgggcgcguccuuuuugaggccaaacuccacaaagguggguuccugaccgugucaagcacuagcacagggccugucguggucccagccaauggcuauuucagauuugauucuuggguuaaucaauuuuacucucuugcccccaugggaacugggaaugggcgcagaagguuucaguaa

SEQ ID NO: 6892 - RNA, 1623 nt, Artificial Sequence
  VP1__Norovirus_and/or_Norovirus-like__AF397156
augaagauggcgucgaaugacgcuacuccaucaaaugauggugccgccggccucgugccagaaaguaauaaugaggcaauggcucuggaacccguggugggggcgucuuuagccgccccugucacuggccaaacuaauauaauagaccccuggauuagaacuaauuuuguccaagccccuaauggugaauuuacaguuuccccuagaaauuccccuggagagauauuggucaauuuggaguuggguccagaacugaauccuuaucuggcacauuuagcuaggauguacaaugguuaugcgggugguauggaggugcaagugaugcucgcggggaacgcguucaccgcuggcaagaucaucuuugccgccgugccaccuuacuuuccaguggaaaaucuuagcccuucccaaauaacaauguucccacaugugauaaucgauguuagaaccuuggaaccuguauugcucccaaugccugaugucagaagcacucuuuuccauuuuaaucagaaggaugaaccuaagaugaggcuuguugccaugcuuuacaccccucuucguucuaaugguucuggugacgacguuuucaccgucucauguaggauucucacuaggcccuccccugaauuugauuuuacauacuuggugccaccaacaguggaaucaaagacuaagccauuuacacuaccugugcuaacauugggagaacuguccaacucuagauuuccucucucuauugaugaaauggucaccagucccaaugaguccauaguuguucagccacagaaugguagggucacauuagauggggagcuguuaggcacaacccaacugcaagcauguaacauuugcuccauaagggggaaggugacagggcaggucccuaaugaacaacacauguggaaccuggagaucacaaaccuaaaugggacgcaauuugacccuacagaugaugucccagccccccuuggugugcccgacuuugcgggugaggucuuuggugugcucagccagagaaacagaggcgaaagcaacccagcaaacagggcucaugaugcugucguggccaccuacagugacaaguacacccccaaauugggcuuagugcaaauuggaacuuggaacaccaaugauguugaaaaccaaccaacaaaauucaccccaauugguuugaaugaggucgcuaauggccaucgauuugaacaguggacuuugccuagguauucuggugcccugacauuaaauaugaauuuagccccugcuguggccccgcucuuuccuggagagcgucuccucuucuuccgcucuuacgucccauuaaaagguggauuuggaaacccugcuauagauugucuggugccucaggaguggguccaacauuucuaucaggaaucugcccccucucugggggauguggccuuagucagguacgucaacccagacaccgggcgcguacuuuuugaggccaaacuccacaaagguggguuccugacugugucaaguacuagcacagggccuguugugguuccagccaauggcuauuucagauuugaccccugggguaaucaauuuuacucucuugcccccaugggaacugggaaugggcgcagaagguuucaguaa

SEQ ID NO: 6893 - RNA, 1623 nt, Artificial Sequence
  VP1__Norovirus_and/or_Norovirus-like__AF414422
augaagauggcgucgaaugacgcuacuccaucaaaugauggugccgccggccucgugccagaaaguaacaaugaggcaauggcucuggaacccguggugggggcgucuuuagccgccccugucacuggccaaacuaauauaauagaccccuggauuagaacuaacuuuguccaagccccuaauggugaauucacaguuuccccuagaaauuccccuggagagauauuggucaauuuggaguuggguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagccccucccaaauaacaauguucccacaugugaucauugauguuagaaccuuggaaccuguauugcucccaaugccugaugucagaagcacccuuuuucacuucaaucaaaaggaugaaccuaaaaugagacuuguugccaugcuuuacaccccucuucguucuaauggcucuggugacgacguuuucaccgucucauguagaauccucacuaggcccuccccugaauuugauuuuacauauuuggugccaccaacaguggaaucaaagacuaagccauucacacuaccugugcuaacacugggagaacuguccaacucuagauuuccucucucuauugaugaaauggucaccagccccaaugaguccauaguuguccagccacagaaugguagggucacacuagauggagagcuguuaggcacaacccaaccgcaagcaugcaacauuugcuccauaagggggaaggugacagggcagguccccaaugaacaacacacguggaaccuggagaucacaaaccuaaaugggacgcaauuugacccuacagaugaugucccagccccccuuggugugcccgauuuugcaggugaggucuuugguguacucagccagagaaauaggggugaaagcaacccagcaaacagggcucaugacgcugucguggccaccuacagugacaaguacaccccuaaauugggcuuagugcaaauuggaacuuggaacaccaaugauguugaaaaccagccaacaaaauucaccccaauugguuugaaugaggucgccaauggccaucgauuugaacaguggacuuugccuagguauucuggugcccugacauuaaauaugaauuuagccccugcuguggccccgcucuuuccuggagagcgucuccuuuucuuccgcucuuacgucccacuaaaagguggauuuggaaacccugcuauagauugucuggugccucaggaguggguccaacauuucuaucaggaaucugcccccucucugggggauguggccuuagucagguacgucaacccagacaccgggcgcguccuuuuugaggccaaacuccacaaagguggguuccugacugugucaaguacuagcacagggccuguugugguuccagccaauggcuauuucggauuugacuccuggguuaaucaauuuuacucucuugcccccaugggaacugggaaugggcgcagaagguuucaguaa

SEQ ID NO: 6894 - RNA, 1623 nt, Artificial Sequence
  VP1__Norovirus_and/or_Norovirus-like__AF414423
augaagauggcgucgaaugacgcuacuccaucaaaugauggugccgccggccucgugccagaaaguaauaaugaggcaauggcucuggaacccguggugggggcgucuuuagccgccccugucacuggccaaacuaauauaauagaccccuggauuagaacuaacuuuguucaagccccuaauggugaauucacaguuuccccuagaaauuccccuggagagauauuggucaauuuggagucggguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagcccuucccaaauaacaauguucccacaugugaucaucgauguuagaaccuuggaaccuguauugcucccaaugccugaugucagaagcaccccuuuucacuucaaucaaaaggaugaaccuaagaugagacuuguugccaugcuuuacaccccucuccguucuaaugguucuggugacgacguuuucaccgucucauguaggauccucacuaggcccuccccugaauuugauuuuacauauuuggugccaccaacaguggaaucaaagacuaagccauucacacuaccugugcugacacugggagaacuguccaacucuagauuuccucucucuauugaugaaauggucaccagccccaaugaguccauaguuguucagccacagaaugguagggucacacuagauggggggcuguuaggcacaacccaacugcaagcaugcaacauuugcuccauaagggggaaggugacagggcaggucccuagugaacaacacauguggaaccuggagaucacaaaccuaaaugggacgcaauuugauccuacagaugaugucccagccccccuuggugugccugauuuugcaggugaggucuuugguguacucagccagagaaauagaggugaaagcaacucagcaaacagggcucaugaugcugucguggcuaccuacagugacaaguacaccccuaaauugggcuuagugcaaauuggaacuuggaacaccaaugauguugaaaaccagccaacaaaauucaccccaauugguuugaauggggucgccaauggccaucgauuugaacaguggacuuugccuagguauucuggugcccugacauuaaauaugaauuuagccccugcuguggccccgcucuuuccuggagagcgucuccuuuucuuccgcucuuacgucccuuuaaaagguggauuuggaaacccugcuauagauugucuggugccucaggaguggguccaacauuucuaucaggaaucugcccccucucugggggauguggccuuagucagguacgucaacccagacaccgggcgcguccuuuuugaggccaaacuccacaaagguggguuccugacugugucaaguacuagcacagggccuguugugguuccagccaauggcuauuucagauuugacuccuggguuaaccaauuuuacucucuugcccccaugggaacugggaaugggcgcagaagguuucaguaa

SEQ ID NO: 6895 - RNA, 1623 nt, Artificial Sequence
  VP1__Norovirus_and/or_Norovirus-like__GQ856476
augaagauggcgucgaaugacgccgcuccaucuaaugauggugcagccggucucguaccagaggucaacaacgagacaauggcacuugagccaguugcgggagcuucaaucgccgccccucuaacuggucaaaacaauguaauagaccccuggauuagauuaaauuuuguacaagccccuaacggugaguucacgguuuccccccgaaacucgccuggugaaauuuuguuaaauuuggaguuagggccugaauugaauccauauuuagcccauuuaucaagaauguauaaugguuaugcaggugggguugaggugcaggugcugcuggcuggaaaugcguuuacagcgggcaaauugguauucgcagcaauccccccccauuucccaguagauaauuugagcccuggucagauuacuauguuuccccaugugauuauugauguuaggacacuugaaccuguuuuauuaccauuaccugauguuaggaauaauuucuuccauuauaaucagcagagugaucagcguaugagacuuguugcuaugcuuuauacuccucuuagaucuaaugguucgggugaugaugucuucacugugucaugcaggguuuuaaccaggccauccccugauuuugauuuuaacuauuugguucccccaacaguugaaucuaaaacuaaacccuucucaguuccagugcugacccucaaugagcugaccaacucucgcuuucccgucccgauugaugccauguacaccagcccuaacgauucaauugugguccaaccucagaaugggagggcaaccauagauggugaguugcuuggcaccacucaacucauccccagugguaucugcucauuuagagggaaaauuacaacacauuuggcagaugauaggcacuuguggaauauccaagucuccaacuugaauggcacuccguuugacccaacggacgacgugccugcaccauugggcaugccagacuuuucugggcaaauauuuggggugguuagccaaagggacacaggcaccaaccccgcaaacagggcucaugaugcuguccuugcaaccuacagugcuaaauauacuccuaagcucggaucaguccaaauuggaacuugggacaccgaggauuuacuugaaagacagccuguuaaauuuacacccguuggucucaaugaaauuggacaagacaagcacuuugaccaaugggucuugccaaauuauucuggugcccuaggacucaauaugcaccuggcuccugcuguguccccacucuucccaggggagaggcugcuguucuuuagaucguauauuccucuaaaagguggccauggggacccauuuauugauugucuugugccucaagaguggauacaacauuuuuaucaagagucagccccagcgcaaucuucgguggcucugcugagguaugugaauccagacacaggucgcacccuguuugaagccaaauuacacaagggaggguuuaucaccgucucuaguacggaaaacaggccugugauuguccccccgaauggcuacuuuagguuugauucuuggguuaaccaauucuauucauuagcccccaugggaacuggcaaugggcgcagaaggaugcaguaa

SEQ ID NO: 6896 - RNA, 1623 nt, Artificial Sequence
  VP1__Norovirus_and/or_Norovirus-like__AJ277607
augaagauggcgucgaaugacgcuacuccaucaaaugauggugccgccggccucgugccagaaaguaauaaugaggcaauggcucuggaacccguggugggggcgucuuuagccgccccugucacuggccaaacuaauauaauagaccccuggauuagaacuaauuuuguccaagccccuaauggugaauucacaguuuccccuaaaaauuccccuggagagauauuggucaauuuggaguuggguccagaacugaacccuuaucuggcacauuuagcuaggauguacaaugguuaugcgggugguauggaggugcaagugaugcuugcggggaacgcguucacugcuggcaagaucaucuuugccgccgugccaccuuacuuuccaguggaaaaucuuagcccuucccaaauaacaauguucccacaugugaucauugaugucagaaccuuggaaccuguauugcucccaaugccugaugucagaagcacccuuuuucacuucaaucaaaaggaugaaccuaaaaugagacuuguugccaugcuuuacaccccucuucguucuaaugguucuggugacgacguuuucaccgucucauguagaauccucacuaggcccuccccugaauuugauuucacauauuuggugccaccaacaguggaaucaaagacuaagccauucacacuaccugugcuaacacugggagaacuguccaacucuagauuuccucucucuauugaugaaauggucaccagccccaaugaguccauaguuguccaaccacagaaugguagggucacacuauauggggagcuguuaggcacagcccaacugcaagcaugcaacauuugcuccauaagggggaaggugacagggcaguuccccaaugaacaaaacauguggaaccuggagaucacaaaccuaaaugggacgcaauuugaccuuacagaugaugucccagccccccuuggugugcccgauuuugcaggugaggucuuugguguacucagccagagaaauagaggugaaagcaacccagcaaacagggcccaugaugcugucguggccaccuacagugacaaguacaccccuaaauugggcuuagugcaaauuggaacuuggaacaccaaugauguugaaaaccagccaacaaaauucaccccaauugguuuaaaugaggucgccaauggccaucgauuugaacaguggacuuugccuagguauucuggugcccugacauuaaauaugaauuuagccccugcuguggccccgcucuuuccuggagagcgucuccuuuucuuccgaucuuacgucccauuaaaagguggauuuggaaacccugcuauagauugucuggugccucaggaguggguccaacauuucuaucaggaaucugcccccucucugggggauguggccuuagucagguacgucaacccagacaccgggcgcguccuuuuugaggccaaacuccacaaagguggguuccugacugugucaaguacuagcacagggccuguugugguuccagccaauggcuauuucagauuugacuccuggguuaaucaauuuuacucucuugcccccaugggaacugggaaugggcgcagaagguuucaguaa

SEQ ID NO: 6897 - RNA, 1623 nt, Artificial Sequence
  VP1__Norovirus_and/or_Norovirus-like__AY772730
augaagauggcgucgaaugacgccgcuccaucuaaugauggugcagccggucucguaccagaggucaacaacgagacaauggcacuugaaccaguugcgggagcuucaaucgcugccccuuuaacuggucaaaacaaugugauagaccccuggauuagauuaaauuuuguacaagcccccaauggugaguucacgguuuccccccgaaacucgccuggugaaauuuuguuaaauuuggaguuagggccugaauugaauccauauuuagcccauuuagcaagaauguauaaugguuaugcaggugggguugaggugcagguacugcuggcuggaagugcguuuacagcgggcaaauugguauucgcagcaauccccccccauuuuccaguagauaauuugagccccggucagaucaccauguuuccccaugugauuauugauguuagaacacuugaaccuguuuuguuaccauuaccugauguuaggaauaauuucuuccauuacaaucaacagagugaucagcgcaugagacuuguugcuaugcuuuacaccccucuuagaucuaaugguucaggugaugaugucuucacugugucaugcaggguuuugaccaggccauccccugacuuugauuuuaacuauuugguucccccaacaguugaauccaaaacuaaacccuucucagucccagugcugacccucaaugagcugaccaacucucgcuuucccgucccgauugaugcuauguacaccagcccuaacgauucaauugugguccaaccucagaaugggagggcaaccauagacggugaguugcuuggcaccacucaacucauccccagugguaucugcucauuuagagggaaaauuacaacacauuugucagaugauaggcacuuguggaauauccaagucuccaacuugaauggcacuccguuugacccaacggaugacgugccggcaccauuggguaugccagacuuuucugggcaaauauuuggggugguuagucaaagggacacaggcaccaaccccgcaaacagggcucaugaugcugcccuugcaaccuacagugccaaauacacuccuaagcucggaucaguccaaauuggagcuugggacaccgaggauuuacuugaaagacagccuguuaaauuuucgcccguuggucucagugaaauuggacaagacaagcacuuugaccaauggguguugccaaauuauuccggugcccuaggacucaacgugcaccuggcuccugcuguauccccacucuuccccggggagagauugcuguucuuuagaucauacauaccuuuaaaagguggccauggggacccauuuauugauugucuugugccucaagaauggauacaacacuuuuaucaagagucagccccagcacaauccucgguggcucugcugagguaugugaauccagacacaggucgcacccuauuugaggccaaauuacacaaggaaggguuuaucaccgucucuaguacggaaaauaggccugugauuguccccccaaaugguuacuuuagguuugauucuuggguuaaccaauuuuacucauuagcccccaugggaacuggcaaugggcgcagaaggaugcaguaa

SEQ ID NO: 6898 - RNA, 1623 nt, Artificial Sequence
  VP1__Norovirus_and/or_Norovirus-like__KT315718
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuucuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaauaaccagccuaacagccgcaugagauuaguggccaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcauuugugcauucagaggacgggugacagcacaaaucaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccugacucaaccagagcccaacaggcgucgguuucaaccuauagcccccaauuuguccccaaauuagguucugucaaucuuagaauuaguaauaaugaugauuuccaauuccagccgacaaaauucacaccagugggcgucaaugaugacgaugauggccacccguucagacaaugggaacuaccaaacuauucaggggagcucaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcaccuucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6899 - RNA, 1623 nt, Artificial Sequence
  VP1__Norovirus_and/or_Norovirus-like__KT315708
augaagauggcgucgaaugacgccgcuccaucuaaugauggugcugcuggucucguaccagagggcaacaacgagacccucccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguuggguccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacuuccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuucuccuuacccauuuuaacccuuucugagcucacaaauucgagguucccaguccccaucgauucgcuuuucaccgcccagaauaauguguugcaggugcagugucaaaauggcagguguacacuugauggugaguuacaaggcacaacucaguugcucccaucuggcaucugugcauucagaggacgggugacagcacaaauuaaccaacgugacagguggcacaugcaacugcaaaaucucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaacuuauagcccccaauuuguccccaaauuagguucuguuaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaccuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacaucacuguggcucacucuggagacuauccucuuguuguuccggcuaauggauacuucagauuugauucuuggguaaaucaguuuuacucacucgccccaaugggaacugggaaugggcgaaggagggcucaguaa

SEQ ID NO: 6900 - RNA, 1623 nt, Artificial Sequence
  VP1__Norovirus_and/or_Norovirus-like__KT315697
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacgugcgcuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6901 - RNA, 1623 nt, Artificial Sequence
  VP1__Norovirus_and/or_Norovirus-like__KT315689
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaacucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaccuuagaauuagugauaaugaugauuuccaauuccagccgacaaaauucacaccagugggcgucaaugaugacgaugauggccacccguucagacaaugggaacuaccaaacuauucaggggaacuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacugugucucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6902 - RNA, 1623 nt, Artificial Sequence
  VP1__Norovirus_and/or_Norovirus-like__KX216805
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaauauaauugaccccuggauuagaacaaauuuugugcaagcaccaaauggagaguucacaguaucacccagaaacucuccuggagaaauuuuauuaaauuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauagcaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucaggucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacaucacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 6903 - RNA, 1623 nt, Artificial Sequence
  VP1__Norovirus_and/or_Norovirus-like__KU557859
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaacacauucuuccauuauaguaaccagccuaacagccgcaugagauuaguggcuaugcucuauaccccacucagaucuaacggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguguuauagauugucuuauuccccaagaauggauccaacacuucuaucaggaaucagcacccucccagucagacguggcccuaaucagguaugucaaccccgauacgggacguacacuguuugaagcaaaauugcacagaucugguuauauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6904 - RNA, 1623 nt, Artificial Sequence
  VP1__Norovirus_and/or_Norovirus-like__KU557828
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaauggcacaacauaugacccaacugaugaugugccagccccgcuggguacaccugacuucaagggcgucguguuugggaugguaagccaaagaaauguggguaaugaugcgccugacucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuuuagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6905 - RNA, 1623 nt, Artificial Sequence
  VP1__Norovirus_and/or_Norovirus-like__KT315692
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccaggaacucuccuggagaaauuuuauuaagcuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguugcaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacgccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaccuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacgcacacuguuugaagcaaaauugcacagaucugguuacauuacuguggcucacucuggagacuauccucucguuguuccggcuaauggacacuuuagauuugauucuuggguaaaucaguuuuacucacucgccccaaugggaacugggaaugggcgaaggagggcucaguaa

SEQ ID NO: 6906 - RNA, 1623 nt, Artificial Sequence
  VP1__Norovirus_and/or_Norovirus-like__KX168437
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaguuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6907 - RNA, 1623 nt, Artificial Sequence
  VP1__Norovirus_and/or_Norovirus-like__KX168440
augaagauggcgucgaaugacgccgcuccaucuaaugauggugcugcuggucucguaccagagggcaacaacgagacccuuccccuagaaccaguugcgggcgcagcuauagccgcaccagucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccuauucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccuuaaugguacaacauaugacccaacugaugaugugccagccccgcuggguacaccugacuucaagggcgucguguuugggaugguaagccaaagaaauguggguagugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggguccaacacuucuaucaggaaucagcacccucccagucagacguggcccuaaucagguaugucaaccccgauacgggacguacacuguuugaagcaaaauugcacagaucugguuacauuacuguggcccacucuggagacuauccucuuguuguuccggcuaauggacacuuuagauuugauucuuggguaaaucaguuuuacucacucgccccaaugggaacugggaaugggcguaggagggcucaguaa

SEQ ID NO: 6908 - RNA, 1623 nt, Artificial Sequence
  VP1__Norovirus_and/or_Norovirus-like__KX216793
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuggaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuacaguaaccagccuaacagccgcaugagauuaguggcuaugcucuauaccccacucaggucuaauggcucaggugaugaugucuuuacugucucuugcaggguuuugacuaggccuacuccugauuuugaguucacuuacuuagugccaccuucuguugaaucuaaaaccaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguuggucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaauuagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6909 - RNA, 1623 nt, Artificial Sequence
  VP1__Norovirus_and/or_Norovirus-like__KU557881
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucgggggagcuuaccuugaauaugaaucuugcccccccaguugcuccaaauuuuccuggugaacaauuguuauucuucagaucucucgugccaugcucaggagguuacaaccaagguauuauagauugucuuauuccccaagaauggauccaacacuucuaucaggaaucagcacccucccagucagacguggcccuaaucagguaugucaacccugauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6910 - RNA, 1623 nt, Artificial Sequence
  VP1__Norovirus_and/or_Norovirus-like__KY424350
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacaaccgcaugagauuaguggcuaugcucuauaccccgcucagaucuaauggcucaggugaugaugucuuuacugucucuugcaggguuuugacuaggccuacuccugauuuugaguucacuuauuuagugccaccuucuguugaaucuaaaacuaagccuuuuucuuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucuaucaaucuuagaauuagugacaaugaugauuuccaauuccagccgacaaaauucacaccagugggcgucaaugaugacgaugauggccacccguucagacaaugggaauuaccaaacuauucaggggagcuuaccuugaauaugaaucuugcccccccaguugcuccaaauuucccuggugaacaauuguuauucuuuagaucuuucgugccaugcucaggagguuacaaccaagguauuauagauugucuuauuccccaagaauggauccaacacuucuaucaggaaucagcacccucccagucagacguggcccuaaucagguaugucaacccugauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6911 - RNA, 1623 nt, Artificial Sequence
  VP1__Norovirus_and/or_Norovirus-like__KU557884
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuacaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccagucccuaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccuuaauggugcaacauaugaccccacugaugaugugccagccccgcuggguacaccugacuucaagggugucguauuugggaugguaagccaaagaaauguggguagugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcucaccuugaauaugaaucuugcccccccaguugcuccaaauuuuccuggugaacaauugcuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6912 - RNA, 1623 nt, Artificial Sequence
  VP1__Norovirus_and/or_Norovirus-like__KU561253
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucacuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacacguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6913 - RNA, 1623 nt, Artificial Sequence
  VP1__Norovirus_and/or_Norovirus-like__KP902588
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccuauucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccuuaaugguacaacauaugacccaacugaugaugugccagccccgcuggguacaccugacuucaagggcgucguguuugggauggugagccaaagaaauguggguagugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuccgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcguaggagggcucaguaa

SEQ ID NO: 6914 - RNA, 1623 nt, Artificial Sequence
  VP1__Norovirus_and/or_Norovirus-like__KX168456
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuagaacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccuuaaugguacaacauaugacccaacugaugaugugccagccccgcuggguacaccugacuucaagggcgucguguuugggaugguaagccaaagaaauguggguagugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugguggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6915 - RNA, 1623 nt, Artificial Sequence
  VP1__Norovirus_and/or_Norovirus-like__KX168444
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccguaugagguuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacucgauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugacgcgccuggcucaaccagagcccaacaggcguggguuucaaccuauagcccccaauuuguccccaaauuagguucugucaaucuuagaauuagugacaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucaucacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaagaagggcucaguaa

SEQ ID NO: 6916 - RNA, 1623 nt, Artificial Sequence
  VP1__Norovirus_and/or_Norovirus-like__KX216806
augaagauggcgacgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggcuaugccgguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaacucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguauuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccaaccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuaucccccaagaauggauccaacacuucuaucaggaaucagcacccucccagucagacguggcccuaaucagguaugucaaccccgacacgggacgcacacuguuugaagcaaaauugcacagaucugguuacauuacuguggcucacucuggagacuacccucuuguuguuccggcuaauggacacuuuagauuugauucuuggguaaaucaguuuuacucacucgccccaaugggaacugggaaugggcgaaggagggcucaguaa

SEQ ID NO: 6917 - RNA, 1623 nt, Artificial Sequence
  VP1__Norovirus_and/or_Norovirus-like__KX216794
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuucgugcaagcaccaaauggagaguucacagugucgcccaggaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucaggucuaauggcucaggugaugaugucuuuacugucucuugcaggguuuugacuaggccuacuccugauuuugaguucacuuacuuagugccaccuucuguugaaucuaaaaccaagccuuuuuccuuaccuauuuuaacccuuugugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuauaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6918 - RNA, 1623 nt, Artificial Sequence
  VP1__Norovirus_and/or_Norovirus-like__KX420895
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaacgcguugcaggugcagugucaaaauggcagguguacacuugauggugaguuacaaggcacaacccaguugcucccaucuggcaucugugcauucagaggacgggugacagcacaaaucaaccaacgugacagguggcacaugcaacugcaaaaccuuaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaguuuuccuggugaacaauuguuauucuucagaucuuucgugccaugcucaggagguuacaaccaagguauuauagauugucuuauuccccaagaauggauucaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6919 - RNA, 1623 nt, Artificial Sequence
  VP1__Norovirus_and/or_Norovirus-like__KT591501
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggauaugcugguggaguggaaauucagguucuccuggcagggaacgcguucacugccggaaagauccucuucgccgccgucccgccaaauuucccaguggaauucuuaagcccagcccagaucacaaugcucccucauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggcccacuccugauuuugaguucacuuacuuagugccaccuucuguugaaucuaaaacuaagccuuuuucuuuaccuauuuuaacccuuucugagcucacaaauucgagguucccaguccccaucgauucgcuuuucaccgcccagaauaauguguugcaggugcaaugucaaaauggcagguguacacuugauggugaguuacaaggcacaacccaguugcucccaucuggcaucugugcauucagaggacgggugacagcacaaaucaaccaacgugacagguggcacaugcaacugcaaaaccucaauggcacaacauaugacccaacugaugaugugccagccccgcuggguacaccugacuucaagggcgucguguuugggaugguaagccaaagaaauguggguagugaugcgccuggcucaaccagagcccaacaggcguggguuucaaccuauagcccccaauuuguccccaaauuagguucugucaaucuuagaauuagugacaaugaugauuuucaauuccagccgacaaaauucacaccagugggcgucaaugaugacgaugauggccacccguucagacaaugggaauuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaacccugauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6920 - RNA, 1623 nt, Artificial Sequence
  VP1__Norovirus_and/or_Norovirus-like__KT315714
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuacaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccuuaaugguacaacauaugacccaacugaugaugugccagccccgcuggguacaccugacuucaagggcgucguguuugggaugguaagccaaagaaauguggguagugaugcgccuggcucaaccagagcccaacaggcguggauuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuacccucuuguuguuccggcuaauggacacuuuagauuugauucuuggguaaaucaguuuuacucacucgccccaaugggaacugggaaugggcgaaggagggcucaguaa

SEQ ID NO: 6921 - RNA, 1623 nt, Artificial Sequence
  VP1__Norovirus_and/or_Norovirus-like__KT315673
augaagauggcgucgaaugacgccgcuccaucuaaugauggugcugcuggucucguaccagagggcaacaacgagacccuuccccuagaaccaguugcgggcgcagcuauagccgcacccguuacuggccaaaauaacauaauugaccccuggauuagaacaaauuuugugcaagcaccaaauggagaguucacagugucacccaaaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggcccacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuuuagaucuuucgugccaugcucaggagguuacaaucaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6922 - RNA, 1623 nt, Artificial Sequence
  VP1__Norovirus_and/or_Norovirus-like__KX216792
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagcauaacagccgcaugagauuaguggcuaugcucuauaccccacucaggucuaauggcucaggugaugaugucuuuacugucucuugcaggguuuugacuaggccuacuccugauuuugaguucacuuacuuagugccaccuucuguugaaucuaaaaccaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaauuuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgacacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6923 - RNA, 1623 nt, Artificial Sequence
  VP1__Norovirus_and/or_Norovirus-like__KU953398
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugacguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcugggaacaccugacuucaagggcgucguguuugggaugguaagccaaagaaauguggguacugacgcgccuggcucaaccagagcccaacaggcguggguuucaaccuauagcccccaauuuguccccaaauuagguucugucaaucuuagaauuagugauaaugaugauuuccaguuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucucagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6924 - RNA, 1623 nt, Artificial Sequence
  VP1__Norovirus_and/or_Norovirus-like__KU557888
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaacggagaguucacagugucacccagaaacucuccuggagaaauuuuauuaaacuuagaguugggcccugauuugaacccuuauuuggcucauuugucaaggauguacaauggguaugcugguggaguugaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcucaacccaguugcucccgucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6925 - RNA, 1623 nt, Artificial Sequence
  VP1__Norovirus_and/or_Norovirus-like__KU557808
augaagauggcgucgaaugacgucgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacaguaucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucuggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugauagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucucagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggguccaacacuucuaucaggaaucagcacccucccagucagacguggcccuaaucagguaugucaaccccgauacgggacguacacuguuugaagcaaaauugcacagaucuggcuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6926 - RNA, 1623 nt, Artificial Sequence
  VP1__Norovirus_and/or_Norovirus-like__KU557807
augaagauggcgucgaaugacgucgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacaguaucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucuggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugauagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucucagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucuggcuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6927 - RNA, 1623 nt, Artificial Sequence
  VP1__Norovirus_and/or_Norovirus-like__KX371111
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaagugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcugggcacaccugacuucaagggcgucguguuugggaugguaagccaaagaaauguggguagugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagauguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6928 - RNA, 1623 nt, Artificial Sequence
  VP1__Norovirus_and/or_Norovirus-like__KX371110
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaaaauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuaguaccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacaugacagguggcacaugcaacugcaaaaccucaaugguacaacauaugacccaacugaugaugugccagccccgcugggaacaccugauuucaagggcgucguguuugggaugguaagccaaagaaauguggguacugacgcgccuggcucaaccagagcccaacaggcguggguuucaaccuauagcccccaauuuguccccaaauuagguucugucaaucuuagaauuagugauaaugaugauuuccaguuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucucagucagacguggcccuaaucagguaugucaaccccgauacgggacguacacuguuugaagcaaaauugcacagaucugguuacauuacuguggcucacucuggagacuauccucuuguuguuccggcuaauggacacuucagauuugauucuuggguaaaucaguuuuacucacucgccccaaugggaacugggaaugggcgaaggagggcucaguaa

SEQ ID NO: 6929 - RNA, 1623 nt, Artificial Sequence
  VP1__Norovirus_and/or_Norovirus-like__KX134669
augaagauggcgucgagugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaaccaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacgcacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6930 - RNA, 1623 nt, Artificial Sequence
  VP1__Norovirus_and/or_Norovirus-like__KU557871
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaaugcguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaauggcacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguaucauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6931 - RNA, 1623 nt, Artificial Sequence
  VP1__Norovirus_and/or_Norovirus-like__KX371108
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugauuugaacccuuauuuggcucauuugucaaggauguacaauggguaugcugguggaguggaaauucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaagugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguagugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6932 - RNA, 1623 nt, Artificial Sequence
  VP1__Norovirus_and/or_Norovirus-like__KU557829
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaacugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaauggcacaacauaugacccaacugaugaugugccagccccgcuggguacaccugacuucaagggcgucguguuugggaugguaagccaaagaaauguggguaaugaugcgccugacucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuuuagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6933 - RNA, 1623 nt, Artificial Sequence
  VP1__Norovirus_and/or_Norovirus-like__KX168452
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccuauucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccagcccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccuuaaugguacaacauaugacccaacugaugaugugccagccccgcuggguacaccugacuucaagggcgucguguuugggaugguaagccaaagaaauguggguagugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcccacucuggagacuauccucuuguuguuccggcuaauggacacuuuagauuugauucuuggguaaaucaguuuuacucacuugccccaaugggaacugggaaugggcguaggagggcucaauaa

SEQ ID NO: 6934 - RNA, 1623 nt, Artificial Sequence
  VP1__Norovirus_and/or_Norovirus-like__KU953393
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauugguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuagcaucugugcauucagaggacgggugacagcacaaauuaaccaacgugacagguggcacaugcaacugcaaaaccuuaaugguacaacauaugacccaacugaugaugugccagccccgcuggguacaccugacuucaagggcgucguguuugggauggugagccaaagaaauguggguagugaugcgccuggcucaaccagagcccaacaggcguggguuucaaccuauagcccccaauuuguccccaaguuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccuugcucaggagguuacaaccaagguauuauagauugucuuauuccccaagaauggauccaacacuucuaucaggaaucagcacccucccagucagacguggcccuaaucagguaugucaaccccgauacggggcgcacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6935 - RNA, 1623 nt, Artificial Sequence
  VP1__Norovirus_and/or_Norovirus-like__KR052020
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucgggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagccagacguugcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaccaguuuuacucacucgccccaaugggaacugggaaugggcgaaggagggcucaguaa

SEQ ID NO: 6936 - RNA, 1623 nt, Artificial Sequence
  VP1__Norovirus_and/or_Norovirus-like__KT315687
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaguaauguguugcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6937 - RNA, 1623 nt, Artificial Sequence
  VP1__Norovirus_and/or_Norovirus-like__KX356908
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugacuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauuuuuccauuauaguaaccagccuaauagccgcaugagauuaguggcuaugcucuauaccccacucagaucuaaugguucaggugaugaugucuuuacuguuucuugcaggguuuugacuaggccuacuccugauuuugaguuuacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucucaucugacaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggauggugagccaaagaaauguggguagugaugcgccuggcucaaccagagcccaacaggcguggguuucaaccuauagcccccaauuuguccccaaauuagguucugucaaucuuagaauuagugacaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaacccugauacggggcguacacuguuugaagcaaaauugcacagaucugguuacauuacuguggcucacucuggagaccauccucuuguuguuccggcuaauggacacuuuagauuugauucuuggguaaaucaguuuuacucacucgccccaaugggaacugggaaugggcgaaggagggcucaguaa

SEQ ID NO: 6938 - RNA, 1623 nt, Artificial Sequence
  VP1__Norovirus_and/or_Norovirus-like__KX024652
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguuuacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuacaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguauuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccacccgacaaaauucacaccagugggcgucaaugaugacaaugauggccccccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacauuucuaucaggaaucagcacccucccagucagacguggcccuaaucagguaugucaaccccgacacgggacgcacacuguuugaagcaaaauugcacagaucugguuacauuacuguggcucacucuggagacuauccucuuguuguuccggcuaauggacacuuuagauuugauucuuggguuaaucaguuuuacucacucgccccaaugggaacugggaaugggcgaaggagggcucaguaa

SEQ ID NO: 6939 - RNA, 1623 nt, Artificial Sequence
  VP1__Norovirus_and/or_Norovirus-like__KT315706
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuaucuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuucugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugacucuuggguaaaucaguuuuacucacucgccccaaugggaacugggaaugggcgaaggagggcucaguaa

SEQ ID NO: 6940 - RNA, 1623 nt, Artificial Sequence
  VP1__Norovirus_and/or_Norovirus-like__KX134670
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcagaguuuugaccaugccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguuccgucaaucuuagaauuagugauaaugaugauuuccaauuccagccgacaaaauucacaccagugggcgucaaugaugacgaugauggccacccguucagacaaugggaacuaccaaauuauucaggggagcuuaccuugaacaugaaucuugcccccccaguugcuccaaauuuuccuggugaacaauuguuauucuucagaucuuucgugccaugcucaggagguuacaaccaagguauuauagauugucuuauuccccaagaauggauccaacauuucuaucaggaaucagcacccucccagucagacguagcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6941 - RNA, 1623 nt, Artificial Sequence
  VP1__Norovirus_and/or_Norovirus-like__KT780399
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcacgguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6942 - RNA, 1623 nt, Artificial Sequence
  VP1__Norovirus_and/or_Norovirus-like__KP902577
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcacgguuuugacuacgccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6943 - RNA, 1623 nt, Artificial Sequence
  VP1__Norovirus_and/or_Norovirus-like__KU587628
augaagauggcgucgaaugacgccgcuccaucuaaugauggugcugcugggcucguaccagagggcaacaacgagacccuuccccuagaaccaguugcgggcgcagccauagccgcacccgucacuggccaaaauaauauaauugaccccuggauuagaacaaauuuugugcaagcaccauauggagaguucacagugucacccagaaacucuccuggagaaauuuuauuaaauuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaaauaagccuuuuuccuuaccuauuuuuacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggaacuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaaugggaacugggaaugggcgaaggagggcucaguaa

SEQ ID NO: 6944 - RNA, 1623 nt, Artificial Sequence
  VP1__Norovirus_and/or_Norovirus-like__AF414409
augaagauggcgucgaaugacgcagcuccaucuaaugauggugcagcaggccucguaccagagaucaacaaugaggucaugccccuugagcccguggcuggugcaucgcuggcgacaccaguuguugggcaacaaaacauaauugaucccuggauaagaaauaauuuuguacaagcuccugcaggugaguuuacaguuuccccuaggaauucccccggugaaaucuugcuugauuuagaguugggaccagaauugaaccccuaccuugcucaucuggcccguauguauaaugggcacgcugguggcauggaagugcaaauuguguuggcugggaaugcguucacagcuggcaagaucauauuugcugccaucccuccaggguucccauaugaaaacuugucaccuucacagauuacaaugugcccacauguuauaauugaugugagacaauuagaaccaguccuauugccuaugccagacauuagaaauaauuucuuccauuauaaucagggcaaugauccaaaauugagguugguggcuaugcucuauacuccuuuaagggcuaauaauucuggugaugauguguucacagucucuuguaggguccuuacuaaaccaucuccugauuuugaauucacauuucuaguucccccuacaguugaauccaaaaccaagcaguuuacauugcccauucucaaaauaucagagaugaccaauucaagauucccagugccaguggaaaugauguauacauccaggaaugagaaucaaguaguccaaccacagaaugguagggucacgcucgauggugagcuauugggcaccacacccuuguuggcugucaacauaugcaaauucaagggagagguuauagcuaagaauggagaugugagauccuacagaauggacauggaaauuaccaacacugauggcaccccaauugaccccacagaagacacaccuggucccauuggcucaccagauuuccaaggcauacucuuuggcguugccagccagcgcaauaagaaugagcaaaaccccgccacaagaucccaugaagcuaauauuaacacugguggggaccaauaugccccuaaauuggcccaagugaagaucuuuucacagucccaggauuuugaggugcaccagcccacagucuucaccccagucgguguggcaggcgacacuucccacccuuucaggcaguggacccugccucgauacggcggacaucucaccaauaacacccacuuggcuccagcaguggccccucuguucccaggugagcagauccuauucuuuagaucacaaauaccuagcucaggcggccaugaauugggcuauauggacugucuugucccacaagaguggguccaacacuucuaucaggaagcugccacagcucagucugagguggcacucauaagguucaucaacccagacacugguagaguccucuuugaggccaagcugcacaagcaaggcuucauaacuguggcucacaccggugauaacccaauugucaugccaccaaacggguacuuuagauuugaagcauggguuaaucaguuuuacucacucgcccccgugggaacugggaaugggcgcaggaggauccaauaa

SEQ ID NO: 6945 - RNA, 1623 nt, Artificial Sequence
  VP1__Norovirus_and/or_Norovirus-like__KT943504
augaagauggcgucgaaugacgcagcuccaucuaacgauggugcagcaggccucgugccagagaucaacaaugaggucaugccccuugagcccguggcuggugcaucgcuggcgacaccaguugucggacaacaaaauauaauugaucccuggauaagaacuaauuuuguacaagcuccugcaggugaguucacagucuccccuagaaauuccccuggugaaauuuugcuugauuuggaguuggggccagaauugaaccccuaucuugcucaucuggcccguauguacaacgggcacgcugguggcauggaagugcaaauuguguuggcugggaacgcguucacagcuggcaagaucauauuugcugccaucccuccaggguucccauaugaaaauuugucaccuucacaaauuacaaugugcccucauguuauaauugauguuagacaauuagaaccaguccuauuaccuaugccagauauuagaaauaauuucuuccauuacaaccagggcaaugauccaaaauugagauugguagcuaugcucuauaccccuuuaagggcuaauaauucuggugaugauguguucacaguuucuuguaggguccucacuaaaccgucaccugauuuugaauucacauuccuaguaccccccacgguugaauccaagaccaagcaguuuacauugcccauccucaagauaucagagaugaccaacucaagauucccagugccaguagaaaugauguacacagccaggaaugagaaccaaguuguccagccacagaaugguagggucacacuugauggcgaacuacuaggcaccacacccuuguuggcugucaacaucugcaaauucaagggagagauuacagcuaagaguguagaugugagguccuauaggauggacauggaaaucaccaacacugauggcaccccaauugaccccacagaagacacaccuggucccauugguucgccugauuuucgagguauacucuuuggcguugccagccaacgcaacaagggugagcaaauccccgccacgagagcccaugaagccaacaucaacacuggcggggaccaauacgcccccaaauuagcccaagugaaauucuucucagggucccaggauuuugaggugcaccagcccacaguuuucaccccaguugguguggcaggcgacucuucccaccccuuccaacagugggcccugccucgauacgguggacaucucaccaauaacacccacuuggcuccagcgguggccccucuauucccaggugagcagauucuauucuuuaggucacaaaucccuagcucaggcggccaugaaauggguuacauggacugccuugucccacaagaauggguccaacacuucuaucaggaagccgcuacagcucagucugaaguggcacucauaagguuugucaacccagacacuggcagaguccuuuuugaggccaaacugcacaagcaaggcuuuauaacuguggcucacacuggugauaacccaauugucaugccaccaaaugggcacuuuagauuugaagccuggguuaaucaguuuuacucacucgcccccgugggaacugggaaugggcgcaggaggauccaauaa

SEQ ID NO: 6946 - RNA, 1623 nt, Artificial Sequence
  VP1__Norovirus_and/or_Norovirus-like__KT943505
augaagauggcgucgaaugacgcagcuccgucuaacgauggugcagcaggccucgugccagagaucaacaaugaggucaugccccuugagcccguggcuggugcaucgcuggcgacaccaguugucggacaacaaaauauaauugaucccuggauaagaacuaauuuuguacaagcuccugcaggugaguuuacagucuccccuagaaauuccccuggugaaauuuugcuugauuuggaguuggggccagaauugaaccccuaucuugcucaucuggcccguauguacaacgggcacgcugguggcauggaagugcaaauuguguuggcugggaacgcguucacagcuggcaagaucauauuugcugccaucccuccaggguucccauaugaaaauuugucaccuucacaaauuacaaugugcccucauguuauaauugauguuagacaauuagaaccaguccuauuaccuaugccagauauuagaaauaauuucuuccauuacaaucagggcaaugauccaaaauugagauugguagcuaugcucuauaccccuuuaagggcuaauaauucuggugaugauguguucacaguuucuuguaggguccucacuaaaccgucaccugauuuugaauucacauuccuaguaccccccacgguugaauccaagaccaagcaguuuacauugcccauccucaagauaucagagaugaccaacucaagauucccagugccaguagaaaugauguacacagccaggaaugagaaccaaguuguccagccacagaaugguagggucacacuugauggcgaacuacuaggcaccacacccuuguuggcugucaacaucugcaaauucaagggagagauuacagcuaagaguguagaugugagguccuauaggauggacauggaaaucaccaacacugauggcaccccaauugaccccacagaagacacaccuggucccauugguucgccugauuuucgagguauacucuuuggcguugccagccaacgcaacaagggugagcaaauccccgccacgagagcccaugaagccaacaucaacacuggcggggaccaauacgcccccaaauuagcccaagugaaauucuucucagguucccaggauuuugaggugcaccagcccacaguuuucaccccaguugguguggcaggcgacucuucccaccccuuccaacagugggcccugccucgauacgguggacaucucaccaauaacacccacuuggcuccagcgguggccccucuauucccaggugagcagauucuauucuuuaggucacaaaucccuagcucaggcggccaugaacuggguuacauggacugccuugucccacaagaauggguccaacacuucuaucaggaagccgcuacagcucagucugaaguggcacucauaagguuugucaacccagacacuggcagaguccuuuuugaggccaaacugcacaagcaaggcuuuauaacuguggcucacacuggugauaacccaauugucaugccaccaaaugggcacuuuagauuugaagccuggguuaaucaguuuuacucacucgcccccgugggaacugggaaugggcgcaggaggauccaauaa

SEQ ID NO: 6947 - RNA, 1623 nt, Artificial Sequence
  VP1__Norovirus_and/or_Norovirus-like__KT962982
augaagauggcgucgaaugacgccgcuccaucuaaugauggugcugcaggucucguaccagagaucaacacugagaccuugccccucgagcccguggccggagcggcaauugcugccccuguuacgggccaaaauaauauaauugaucccuggauuagaaacaauuuugugcaggccccuaauggugaguuuacagucuccccuagaaauuccccuggugaaauuuuaaugaauuuggagcuagggccagaucuuaauccauauuuggcucaccuaucaagaauguacaaugguuaugcuggaggaguggaagugcaagugcuccuagcugggaaugcguucacggcaggaaagauccuuuuugcagcaguccccccaaauuuccccguugauaugcuuaguccugcucaaaucacaaugcuuccccauuuaauuguagaugucagaacuuuggagcccauuaugaucccucugccugauguuaggaacguuuucuaucacuuuaauaaccagccugccccaagaaugagauugguugcuaugcucuacacuccuuuaagauccaauggguccggugaugauguauucacugucuccugcagggugcuaaccagaccuacuccggacuuugaguuuacauauuugguuccccccucgguagaguccaaaaccaagccuuucacccuacccauccuaacaauuggagaguugacaaauucuagauucccagccccgaucgaucaguuguacacuucacccaacgcugauguaguuguccaaccccaaaauggccggugcacacuggacggugagcuacaaggcacaacacaacuuuugacaacggcaauauguucauacaagggcacaacaucaaaccccacuagugacuacugggaugaucaccuccugcacuugguccaccccaauggggcaacauaugacccgaccgaggacgugccagcuccuuuuggcacgcaggacuuucggggcauucuguaugggguguugacucaaaacacccaaaaucccagggacgaagucuccaacucccgugggaucuacaucucauccacuagugacaaguucacuccaaaauuggguacaauugguuuacaccaagugcaaggcgacacagccagcaaccaacaaucaaaauucacaccaguagggauagcggugaaucaaaacacuccuuucaaacagugggaacucccaaacuacucuggugcccucacccucaacacaaaccuugcaccagcgguugggcccaacuucccuggggagcaaauccuuuucuucaggucaaauguuccaaguguucaagguaaccacccuacucaagagauugacugccugaucccacaagaauggguuucccacuucuaucaagaaucagcucccucucagagugauguggcuuuggucagguaugucaauccugacacagggcgcacaaucuuugaggccaaacugcauaggcagggauuuaucaccauagcggccacuggaagcaaccccguggucgugccccccaauggguacuucagauuugacuccugggucaaccaguuuuaugcacucgcccccaugggaacugggaaugggcgcagaagagcucaauaa

SEQ ID NO: 6948 - RNA, 1623 nt, Artificial Sequence
  VP1__Norovirus_and/or_Norovirus-like__KX079488
augaagauggcgucgaaugacgccgcuccaucuaaugauggugcugcaggucucguaccagagaucaacacugagaccuugccccucgagcccguggccggagcggcaauugcugccccuguuacgggccaaaauaauauaauugaucccuggauuagaaacaauuuugugcaggccccuaauggugaguuuacagucuccccuagaaauuccccuggugaaauuuuaaugaauuuggagcuagggccagaucuuaauccauauuuggcucaccuuucaagaauguacaaugguuaugcuggaggaguggaagugcaagugcuccuagcugggaaugcguucacggcaggaaagauccuuuuugcagcaguccccccaaauuuccccguugauaugcuuaguccugcucaaaucacaaugcuuccccauuuaauuguagaugucagaacuuuggagcccauuaugaucccucugccugauguuaggaacguuuucuaucacuuuaauaaccagccugccccaagaaugagauugguugcuaugcucuacacuccuuuaagauccaauggguccggugaugauguauucacugucuccugcagggugcuaaccagaccuacuccggacuuugaguuuacauauuuaguuccccccucgguagagucuaaaaccaagccuuucacccuacccauccuaacaauuggagaguugacaaauucuagauucccagccccgaucgaucaguuguacacuucacccaacgcugauguaguuguccaaccccaaaauggccggugcacacuggacggugagcuacaaggcacaacacaacuucugacaacggcaauauguucauacaggggcacaacaucaaaccccacuagugacuacugggaugaucaccuccugcacuugguccaccccaauggggcaacauaugacccgaccgaggacgugccagcuccuuuuggcacgcaggacuuucggggcauucuguaugggguguugacucaaaacacccaaaaucccagggacgaagucuccaacucccgugggaucuacaucucauccacuagugacaaguucacuccaaaauuggguacaauuggcuuacaccaagugcaaggcgacacagccagcaaccaacaaucaaaauucacaccaguagggauagcggugaaucaaaacacuccuuucaaacagugggaacucccaaacuacucuggugcccucacccucaacacaaaccuugcaccagcgguugggcccaacuucccuggggagcaaauccuuuucuucaggucaaaugucccaaguguucaagguaaccacccuacucaagagauugauugccugaucccacaagaauggguuucccacuucuaucaagaaucagcucccucucagagugauguggcuuuggucagguaugucaauccugacacagggcgcacaaucuuugaggccaaacugcauaggcagggauuuaucaccauagcggccacuggaagcaaccccguggucgugccccccaauggguacuucagauuugauuccugggucaaccaguuuuaugcacucgcccccaugggaacugggaaugggcgcagaagagcucaauaa

SEQ ID NO: 6949 - RNA, 1623 nt, Artificial Sequence
  VP1__Norovirus_and/or_Norovirus-like__KR921938
augaagauggcgucgaaugacgccgcuccaucuaaugauggugcugcaggucucguaccagagaucaacacugagaccuugccccucgagcccguggcuggagcggcaauugcugccccuguuacgggccaaaauaauauaauugaucccuggauuagaaauaauuuugugcaggccccuaauggugaguuuacagucuccccuagaaauuccccuggugaaauuuuaaugaauuuggagcuagggccagaucuuaauccauauuuggcucaccuuucaagaauguacaaugguuaugcuggaggaguggaagugcaagugcuccuagcugggaaugcguucacggcaggaaagauccuuuuugcagcaguccccccaaauuuccccgucgauaugcuuaguccugcucaaaucacaaugcuuccccauuuaauuguagaugucagaacuuuggagcccauuaugauuccucugccugauguuaggaauguuuucuaucacuuuaacaaccagccugccccaagaaugagauugguugcuaugcucuacacuccuuuaagauccaauggguccggugaugauguauucacugucuccugcagggugcuaaccagaccuacuccggacuuugaguuuacauauuuaguuccccccucgguagaguccaaaaccaagccuuucacccuacccauccuaacaauuggagaguugacaaauucuagauucccagccccgaucgaucaauuguacacuucacccaacgcugauguaguuguccaaccccaaaauggccggugcacacuggacggugagcuacaaggcacaacacaacuuuugacaacggcaauauguucauacaggggcacaacaucaaaccccacuagugacuacugggaugaucaccuccugcacuugguccaccccaauggggcaacauaugacccgaccgaggacgugccagcuccuuuuggcacgcaggacuuucggggcauucuguaugggguguugacucaaaacacccaaaaucccagggacgaagucuccaacucccgugggaucuacaucucauccacuagugacaaguucacuccaaaauuggguacaauuggcuuacaccaagugcaaggcgacacagccagcaaccaacaaucaaaauucacaccaguggggauagcggugaaucaaaacacuccuuucaaacagugggaacucccaaacuacucuggugcccucacccucaacacaaaccuugcaccagcgguugggcccaacuucccuggggagcaaauccuuuucuucaggucaaauguuccaaguguucaagguaaccacccuacucaagagauugauugccugaucccacaagaauggauuucccacuucuaucaagaaucagcucccucucagagugauguggcuuuggucagguaugucaacccugacacagggcgcacaaucuuugaggccaagcugcauaggcagggauuuaucaccauagcggccacuggaagcaaccccguggucgugccccccaauggguacuucagauuugauuccugggucaaccaguuuuaugcacucgcccccaugggaacugggaaugggcgcagaagagcucaauaa

SEQ ID NO: 6950 - RNA, 1623 nt, Artificial Sequence
  VP1__Norovirus_and/or_Norovirus-like__KR921940
augaagauggcgucgaaugacgccgcuccaucuaaugauggugcugcaggucucguaccagagaucaacacugagaccuugccccucgagcccguggccggagcggcaauugcugccccuguuacgggccaaaauaauauaauugaucccuggauuagaaacaauuuugugcaggccccuaauggugaguuuacagucuccccuagaaauuccccuggugaaauuuuaaugaauuuggagcuagggccagaucuuaauccauauuuggcucaccuuucaagaauguacaaugguuaugcuggaggaguggaagugcaagugcuccuagcugggaaugcguucacggcaggaaagauccuuuuugcagcaguccccccaaauuuccccguugauaugcuuaguccugcucaaaucacaaugcuuccccauuuaauuguagaugucagaacuuuggagcccauuaugaucccucugccugauguuaggaacguuuucuaucacuuuaauaaccagccugccccaagaaugagauugguugcuaugcucuacacuccuuuaagauccaauggguccggugaugauguauucacugucuccugcagggugcuaaccagaccuacuccggacuuugaguuuacauauuuaguuccccccucgguagaguccaaaaccaagccuuucacccuacccauccuaacaauuggagaguugacaaauucuagauucccagccccgaucgaucaguuguacacuucacccaacgcugauguaguuguccaaccccaaaauggccggugcacacuggacggugagcuacaaggcacaacacaacuucugacaacggcaauauguucauacaggggcacaacaucaaaccccacuagugacuacugggaugaucaccuccugcacuugguccaccccaauggggcaacauaugacccgaccgaggacgugccagcuccuuuuggcacgcaggacuuucggggcauucuguaugggguguugacucaaaacacccaaaaucccagggacgaagucuccaacucccgugggaucuacaucucauccacuagugacaaguucacuccaaaauuggguacaauuggcuuacaccaagugcaaggcgacacagccagcaaccaacaaucaaaauucacaccaguagggauagcggugaaucaaaacacuccuuucaaacagugggaacucccaaacuacucuggugcccucacccucaacacaaaccuugcaccagcgguugggcccaacuucccuggggagcaaauccuuuucuucaggucaaaugucccaaguguucaagguaaccacccuacucaagagauugauugccugaucccacaagaauggguuucccacuucuaucaagaaucagcucccucucagagugauguggcuuuggucagguaugucaauccugacacagggcgcacaaccuuugaggccaaacugcauaggcagggguuuaucaccauagcggccacuggaagcaaccccguggucgugccccccaauggguacuucagauuugauuccugggucaaccaguuuuaugcacucgcccccaugggaacugggaaugggcgcagaagagcucaauaa

SEQ ID NO: 6951 - RNA, 1623 nt, Artificial Sequence
  VP1__Norovirus_and/or_Norovirus-like__DQ358209
augaagauggcuucuaaugacgcugccccuuccaacgauggugcugcuggucuggugccugaaaucaacaaugaggugaugccucuggagccuguggcuggugcuucccuggcuaccccuguggucggucagcaaaacaucauugauccuuggauccguaacaauuucgugcaagcuccugcuggugaguucaccguguccccucguaacuccccuggugaaauccugcuggaucuggagcuggguccugagcugaacccuuaccuggcucaccuggcucguauguacaacggucacgcugguggcauggaggugcaaauugugcuggcugguaacgcuuucaccgcugguaagaucguguucgcugccaucccuccagguuucccuuacgaaaaccugucuccuucccagaucaccaugugcccucacgugaucauugacgugcgucaacuggagccugugcugcugcucaugccugacauuaagaacaauuucuuccacuacaaccaggguaacgacccuaaacugcgucugguggcuaugcuguacacuccucugcgugcuaacaauuccggugacgauguguucaccgugucuugccgugugcugaccaaaccuuccccugacuucgaguucacuuuccuggugccucccaccguggaauccaagaccaagcaguucacucugccuauucugaagaucucugagaugaccaauucucguuucccugugccuguggagaugauguacacugcucguaacgagaaccaggugguccagccucagaacggucgugugacucuggauggugagcugcucgguaccacuccucugcucgcugugaacaucugcaaauucaagggugaggugauugcuaagaacggugacgugcguucuuaccguauggacauggagaucaccaacacugaugguacuccuaucgacccuaccgaagacaccccugguccuaucgguucuccugacuuccaggguauccuguucgguguggcuucucagcguaacaagaacgagcagaacccugcuacccgugcucaggaagugaacauuaacacugguggcgaccaauacgcuccuaagcuggcucaggugaaguucuucuccgagucccaagacuucgaggugcaccagccuacuguguucaccccuguggguguggcuggugacccuucucacccuuuccgucaguggacccugccucguuacgguggccaccugaccaacaauauccaccuggcuccugccgucgccccccuguuucccggugagcagauccuguucuuucgcucccagaucccuuccucugguggccacgaacuggguuacauggacugccuggugccucaggagugggugcagcacuucuaccaggaagcugcuaccgcucagucugagguggcucugauccguuucaucaacccugacaccggucgugugcuguucgaggcuaagcugcacaagcaggguuucaucaccguggcucacaccggugacaacccuaucgugaugccuccuaacgguuacuuccguuucgaagcuugggugaaccaguucuacucccuggcuccuguggguaccgguaacggucgucgccgugugcaguaa

SEQ ID NO: 6952 - RNA, 1623 nt, Artificial Sequence
  VP1__Norovirus_and/or_Norovirus-like__KP784694
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuuaggcccugaucuaaaccccuaccuaucccacuuggccagaauguacaaugguuaugcaggugguuuugaagugcaggugauccuugcggggaacgcguucaccgccgggaagaucauauuugcagcagacccaccaaauuucccaacugaaggcuugagccccagccaggucacuauguucccccauauaauaguagauguuaggcaacuagaaccuguguugauccccuuacccgauguuaggaacaauuucuaccauuauaaucaaucaaaugaccccacuaucaaguugauagcaauguuguacacaccacuuagggcuaauaaugcuggggacgaugucuuuacaguuucuugccgaguucucacgaggccaucccccgauuuugacuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugacggcgugcuccuagguacuacccaacugucuccugucaacaucugcaccuucagaggggaugucacucauauugcagguucucacaacuacacaaugaauuuggccacucaaaauuggaacaguuaugacccaacagaagaaaucccagccccucuaggaacuccagauuucguggggaagauucaagguguacucacccaaaccacaaagacagauggcucgacacgcagccacaaagcuacaguguacacugggagcgccgacuuugcuccaaaauuggguagaguucaauuugaaacugacacaaacaaugauuuugaaaccaaccaaaacacaaaguucaccccagucggugucauccagaauggugaaacugcccacaggaaugaaccccaacagugggugcucccaaguuacucaggcagaaauacucccaaugugcauuuggcccccgcuguagcccccacuuuuccgggugaacaacuucucuucuucagauccacuaugcccggaugcagcggguaucccaacauggauuuggacugucugcucccccaggaaugggugcaguacuucuaccaagaggcagccccagcgcaaucugauguggcucuacuaagauuugugaacccagacacagguaggguuuuguuugaguguaagcuucauaaaucaggcuauguuacaguggcucacacugguucacaugauuugguuauccccccuaaugguuauuuuagguuugauuccugggucaaccaguucuacacacuugcccccaugggaaaugggacggggcguagacgugcaacauaa

SEQ ID NO: 6953 - RNA, 1623 nt, Artificial Sequence
  VP1__Norovirus_and/or_Norovirus-like__KX354064
augaagauggcgucgagugacgccaacccaucugauggguccgcagccaaccucgucccagaggucaacaaugagguuauggcucuggagcccguuguuggugccgccaucgcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacaggucccagcagugccuuuguuguccaaccacaaaacggcaggugcacgacugauggcgugcuccuaggcaccacccaacugucuccugucaacaucugcacauucagaggagaugucacccauaucacagguagccguaauuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccacuaugcccggaugcagcggguaccccaacauggauuuggacuguuugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacgugcaauguaa

SEQ ID NO: 6954 - RNA, 1623 nt, Artificial Sequence
  VP1__Norovirus_and/or_Norovirus-like__LC177658
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacagugucccccagaaacgcuccaggugaaauacuauggagcgcgcccuuaggcccugauuugaaucccuaccuaucccauuuggccagaauguauaaugguuaugcaggugguuuugaagugcagguaauucucgcggggaacgcguucaccgccgggaaggucauauuugcagcagucccaccaaauuuuccaacugaaggcuugagccccagccaggucacuauguucccccacauaguaguagauguuaggcaacuagaaccuguguugauucccuuacccgauguuaggaauaauuucuaucacuacaaucaaucaaaugaccccaccauuaaguugauagcaauguuguauacaccacuuagggcuaauaaugcuggggacgaugucuucacaguuucuugccgaguucucacaagaccaucccccgauuuugauuucauauuucuagugccacccacaguugagucuagaacuaaaccauucucugucccaguuuuaacuguugaggagaugaccaauucaagauuccccauuccuuuggaaaaguuguucacgggucccagcagugccuuuguuguucaaccacaaaacgguaggugcacgacugauggcgugcuccuaggcaccacccaauugucuccugucaacaucugcaccuucagaggggaugucacccacauuacagguagucgcaacuacacaaugaauuuggcuucucaaaauuggaauaauuaugacccaacagaagaaaucccagccccucuaggagcuccagauuuuguggggaagauucaaggcaugcucacccaaaccacaagggcagauggcucaacacgcggccacaaggcuacgguguacacugggagcgccgacuuugccccaaaacugggcagaguucaauuugagacugacacagaccaugauuuugaagcuaaccaaaacacaaaguucaccccagucggugucauccaagaugguggcaccacccaccgaaaugaaccccaacagugggugcucccaaguuacucaggcagaaauacucauaauguucaucuggcccccgcuguagcccccacuuuuccgggugagcaacuucucuucuuuagauccaccaugcccggauguagcggguaccccaacauggauuuggacugucugcucccccaggaaugggugcaguacuucuaccaagaggcagccccagcacaaucugauguggcucugcuaagguuugugaauccagacacagguaggguuuuguuugaguguaaacuucauaaaucaggcuauguuacaguggcucacacuggccaacaugauuugguuaucccccccaaugguuauuuuagguuugauuccugggucaaccaguucuacacgcuugcccccaugggaaauggagcggggcguagacguguagcauaa

SEQ ID NO: 6955 - RNA, 1623 nt, Artificial Sequence
  VP1__Norovirus_and/or_Norovirus-like__KX514232
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcgugccucauaa

SEQ ID NO: 6956 - RNA, 1623 nt, Artificial Sequence
  VP1__Norovirus_and/or_Norovirus-like__LC145787
augaagauggcgucgaaugacgccgcuccaucuacugauggugcagccggccucgugccagaaaguaacaaugaggucauggcucuugaacccguggcuggugccgccuuggcagcaccggucaccggucaaacaaauauuauagacccuuggauuagagcaaauuuuguccaggcccccaauggcgaauuuacagucucuccccguaaugccccuggugaagugcuauuaagucuagaauuggguccagaauuaaauccuuaucuggcacauuuagcaagaauguacaacggguaugccggugggauggaggugcaggucauguuggcugggaaugcguucacagccggcaaguuggucuucgccgcugugccaccucacuucccgguugaaaaccuuagcccacagcaaauuaccauguucccucaugugauuauagauguaaggaccuuggaaccuguuuuauuaccacucccugauguuaggaauaauuucuuccauuauaaucagaaagaugaucccaaaaugagaauuguggcuaugcuuuauaccccccuuagaucuaaugguucaggugaugauguguucacaguuuccugcaggguguugaccagacccuccccugauuucgauuucacauaucuggugccaccaacaguggaaucuaaaacaaaaccauucacccucccaauccucacacuuggggaacuuuccaauucuagguucccaguguccauagaccagauguacaccagcccuaaugaaguuauaucagugcagugucaaaaugguaggugcacauuggacggggaacuucaagggacaacacaacuccaagucaguggcauuugugcuuucaagggggaagugaccgcccauuugcaugacaaugaucaccuauacaaugucaccaucacaaacuugaauggguccccuuuugaccccuccgaggacguuccugccccucugggcgugccugauuuccagggaagggucuuugguauuaucucccaaagagacaaacauaauagcccugggcauaaugaaccagcaaacaggggacacgacgcuguggucccuacuuacacagcacaguacacuccaaaauugggucagauucaaauuggcacauggcagaccgaugaucuuacagucaaccaaccagucaaauucaccccaguuggacucaaugacacugaacauuuuaaucaaugggugguccccagauacgcuggugcccuaaaccucaacacaaaccuugccccuucuguugcuccgguauuuccaggggagcgccugcuuuucuucagaucauacguuccccucaagggugguuauggaaauccagccauugauugccuauuaccacaagagugggugcaacacuucuaucaggaagcugccccaucaaugagugagguggcccuugucagauacaucaacccggauacuggucgggcacuguuugaggccaagcuccacagagcugguuucaugacagucucgagcaacaccagugccccggugguugugccugccaauggguacuucagauuugacucuuggguuaaucaauucuauucucucgcccccaugggaacuggaaaugggcguagaagguaa

SEQ ID NO: 6957 - RNA, 1623 nt, Artificial Sequence
  VP1__Norovirus_and/or_Norovirus-like__KT962983
augaagauggcgucgaaugacgccgcuccaucuacugauggugcagccggccucgugccagaaaguaauacugaggucauggcucuugaacccguggcuggugccgcuuuggcagccccagucacuggucaaacaaauauuauagacccuuggauuagagcaaauuuuguccaggcccccaauggugaauuuacagucuccccccguaaugccccuggugaagugcuacuaaaucuggaguuggguccagaauuaaauccuuaucuggcacacuuagcaagaauguacaacggguaugccggugggauggaggugcaggucauguuggcugggaacgcguucacagccggcaaguuggucuucgccgccgugccaccucacuucccgguugaaaaccuuaguccacaacaaauuaccauguucccucaugugauuauagauguaaggacuuuggaaccugucuuauuaccacucccugauguuagaaauaauuucuuucauuacaaucagaaagaugaucccaagaugagaauuguggcuaugcuuuauaccccccuuagaucaaauggcucaggugaugauguguucacagucuccuguaggguguuaacuaggcccuccccugacuuugacuucacauaucuggugccaccaacaguggagucuaaaacaaaaccauucacccucccaauccucacacuuggggaacuuuccaauuccagauucccagugucuauagaccagauguacaccagcccuaaugaaguuauaucagugcagugucaaaaugguaggugcacauuggacggggagcuccaagggacaacacaacuccaggucaguggcauuugugcuuucaagggagaggugaccgcccacuugcaugacaaugaucaccuauacaauaucaccaucacaaacuugaauggauccccuuuugaccccucugaggacaucccugccccucugggcguaccugacuuucagggaagggucuuugguauuaucucccaaagggacaaacacaauagcccuggacauaaugaaccagcaaacaggggacacgacgcuguggucccuacuuacacagcacaguauacuccaaaauugggucagauucaaauuggcacauggcagacugacgaucucacugucaaccaaccaguaaaauucaccccaguuggacucaaugauacugaacauuuuaaccaaugggugguccccagauaugcuggugcccuaaaccucaacacaaaccuugccccuucuguugccccaguauuuccaggggagcgccugcucuuuuucagaucauacaucccccucaaggguggcuauggaaauccagccauugauugccuacuaccacaagagugggugcaacacuucuaccaggaagcagccccuucaaugagugagguggcccuugucagguacaucaacccggacacuggucgggcacuguuugaggccaagcuccacagagcugguuucaugacggucucaaguaacaccagugccccggugguuguaccugccaauggauacuucagguuugacucuugggugaaccaauuuuauucucucgcccccaugggaacuggaaaugggcguagaagguaa

SEQ ID NO: 6958 - RNA, 1623 nt, Artificial Sequence
  VP1__Norovirus_and/or_Norovirus-like__AB629946
augaagauggcgucgaaugacgccgcuccaucuacugauggugcagccggccucgugccagaaaguaacaaugaggucauggcucuugaacccguggcuggugccgccuuggcagcaccggucaccggucaaacaaauauuauagacccuuggauuagagcaaauuuuguccaggcccccaauggcgaauuuacagucucuccccguaaugccccuggugaagugcuauuaagucuagaauuggguccagaauuaaauccuuaucuggcacauuuagcaagaauguacaacggguaugccggugggauggaggugcaggucauguuggcugggaaugcguucacagccggcaaguuggucuucgccgcugugccaccucacuucccgguugaaaaccuuagcccacagcaaauuaccauguucccucaugugauuauagauguaaggaccuuggaaccuguuuuauuaccacucccugauguuaggaauaauuucuuccauuauaaucagaaagaugaucccaaaaugagaauuguggcuaugcuuuauaccccccuuagaucuaaugguucaggugaugauguguucacaguuuccugcaggguguugaccagacccuccccugauuucgauuucacauaucuggugccaccaacaguggaaucuaaaacaaaaccauucacccucccaauccucacacuuggggaacuuuccaauucuagguucacaguguccauagaccagauguacaccagccuuaaugaaguuauaucagugcagugucaaaaugggaggugcacauuggacggggaacuucgagggacaacacaacuccaagucaguggcauuugugcuuucaagggggaagugaccgcccaugugcaugacaaugaucaccuauacaaugucaccaucacaaacuugaauggguccccuuuugaccccuccgaggacguuccugccccucugggcgugccugauuuccagggaagggucuuugguauuaucucccaaagagacaaacauaauagcccugggcauaaugaaccagcaaacaggggacacgacgcuguggucccuacuuacacagcacaguacacuccaaaauugggucagauucaaauuggcacauggcagaccgaugaucuuacagucaaccaaccagucaaauucaccccaguuggacucaaugacacugaacauuuuaaucagugggugguccccagauacgcuggugcccuaaaccucaacacaaaccuugccccuucuguugcuccgguauuuccaggggagcgccugcuuuucuucagaucauacguuccccucaagggugguuauggaaauccagccauugauugcuuauuaccacaagagugggugcaacacuucuaucaggaagcugccccaucaaugagugagguggcccuugucagauacaucaacccggauacuggucgggcacuguuugaggccaagcuccacagagcugguuucaugacagucucgagcaacaccagugccccggugguugugccugccaauggguacuucagauuugacucuuggguuaaucaauucuauucucucgcccccaugggaacuggaaaugggcguagaagguaa

SEQ ID NO: 6959 - RNA, 1623 nt, Artificial Sequence
  VP1__Norovirus_and/or_Norovirus-like__AB809993
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaucccacugaugaaguaccagcacccuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccgugucccauguguucaaggccugcgggggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgcccccaugggaacuggcaaugggcguagaagauaa

SEQ ID NO: 6960 - RNA, 1623 nt, Artificial Sequence
  VP1__Norovirus_and/or_Norovirus-like__JQ743330
augaugauggcgucuaaggacgccccaccaaacauggauggcaccaguggugccggccagcugguaccagaggcaaauacagcugagccuauaucaauggagccuguggcuggggcagcaacagcugccgcgaccgcuggccaaguuaauaugauugaccccuggauaaugaauaauuaugugcaagccccucaaggugaauuuacuauaucgcccaauaacacaccaggugauauuuuguuugaccuacaauuaggcccccaucucaauccuuucuuaucccauuuggcccaaauguauaaugguuggguuggcaauaugaaagugaagguccuauuggcugguaaugccuucacggcuggcaaaauaauuauuaguugcauacccccuggcuuugcugcacaaaacaucuccauugcucaagcuacaauguuuccccacgucauagcugauguuaggguucuagaaccuauugaagugccacuggaagaugugagaaaugugcuguuccauaacaaugacaacacaccaaccaugagguuggugugcaugcucuacacccccuugcgagccaguggcagcucaucugggacugacccuuuugugauugcugggcguguauuaacaugcccaagcccugauuuuagcuuuuuauucuuggucccccccaauguagaacaaaagacuaaaccauuuagugucccaaaucuuccauugaacacccuuucaaauucaagagucccuucucuaauuaggucaaugaugguguccagagaccaugggcagaugguucaguuucaaaaugguagggucacccuagaugggcaacugcaaggcaccacacccacaucagcuagccaacugugcaaaaucagaggcagugucuuccacgcuaauggugggaauggguauaacuuaacugaacuggaugggagcccauaccaugcauuugagagcccugcgccaauaggguuuccagacuugggugagugugauuggcacauggaggccuccccuaccacccaauucgauacuggugauguuauaaagcaaauuaaugucaaacaagaagcagcauuugcuccccaccuugguacuauacaagcagacggccugagugaugugagugucaacacuaacaugauagcuaaauuaggaugggugucacccgucagugauggacauagagggagugucgauccgugggucauuccacgauacgggucgacuuugacugaggccgcccaacuagccccuccaauauaucccccagguuuuggugaggccauuguguuuuucaugucagauuuuccuauugcccauggugcaaauggcuugagugugccuugcaccauaccccaagaauuugucacucauuuugucaaugaacaggccccuacuagaggggaagcagcccuacugcauuauuuagauccugacacccauagaaaucuaggugaguucaaacuauauccugagggcuucaugacgugugugccuaacuccaguggcacugguccacaaacccucccaaucaaugguguuuuugcuuuuguguccuggguuuccagauucuaucaguuaaagccugugggaacagccggcccggcucguaggcuuuaa

SEQ ID NO: 6961 - RNA, 1623 nt, Artificial Sequence
  VP1__Norovirus_and/or_Norovirus-like__AF439267
augaugauggcgucuaaggacgccccaacaaacauggauggcaccaguggugccggccagcugguaccagaggcaaauacagcugagccuauaucaauggagcccguggcuggggcagcaacagcugccgcaaccgcuggccaaguuaauaugauugaccccuggauaaugaauaauuaugugcaagccccucaaggugaauucaccauaucgccuaacaacacaccaggugauauuuuguuugauuuacaauuaggcccccaccucaacccuuucuuaucccauuuggcccaaauguauaauggcuggguuggcaauaugaaagugaagguuuuauuggcugguaaugccuucacggcugguaaaauaauuauuaguugcauacccccuggcuuugcugcacaaaacauuucuaucgcucaggcuacuauguucccccaugucauagcugauguuaggguuuuggaacccauugaggugccauuggaagaugugaggaaugugcuguuccacaacaaugacaacacaccaaccaugagguuggugugcaugcucuacacccccuugcgagccagugguagcucgucuggaacugaccccuuugugauugcugggcguguuuugacaugcccgagcccugauuuuagcuuuuuguuuuugguuccccccaauguagaacaaaagacuaaaccuuuuagugucccaaaccuuccauugaauacucuuucaaauucgagagucccuucucuaaucaaaucaaugaugguauccagggaccaugggcagaugguucaguuucaaaaugguagggucacccuagaugggcaacugcaaggcaccacgcccacaucagcuagccagcugugcaaaaucaggggcagugucuuccaugccaauggugggaauggguauaaccuaacagaacuggaugggagcccauaccaugcauuugagagccccgcaccagugggguuuccagaucuaggugagugugacuggcacauggaggcuuccccuaccacccaauucaauacuggugauguuauaaaacaaauuaaugucaaacaagagucagcauuugccccccaccuugguacuauacaggcagacggccugagugaugugagugucaacaccaacaugauagcuaaauuaggaugggugucgcccgucagugauggacacaaaggagaugucgauccgugggucaucccacgcuaugggucgacuuugacugaggccgcccaauuagccccuccaauauaucccccagguuuuggugaggccauuguguucuucaugucagauuucccuauugcccaugguaccaauggcuugagugugccuugcaccauaccccaagaauuugucacccauuuugucaaugaacaggccccuacuagaggggaagcagccuuacuacauuauuuggauccugauacucauagaaaucuuggugaauuuaaauuauauccugauggcuucaugacaugugugccuaacuccaguggcacugguccacaaacucuuccaaucaauggugucuuuguuuuuguguccuggguuuccagauucuaucaauuaaagccugugggaacagccggcccggcucguaggcuuuaa

SEQ ID NO: 6962 - RNA, 1623 nt, Artificial Sequence
  VP1__Norovirus_and/or_Norovirus-like__EF547393
augaugauggcgucuaagggcgccccaacaaacauggauggcaccaguggugccggccagcugguaccagaggcaaacacagcugagccuauaucaauggagcccguggcuggggcagcaacagcugccgcaaccgcuggccaaguuaauaugauugaccccuggauaaugaauaauuaugugcaagccccucaaggugaauucaccauaucgccuaacaacacaccaggugauauuuuguuugauuuacaauuaggcccccaccuuaacccuuucuuaucccauuuggcccaaauguauaauggcuggguuggcaauaugaaagugaagguuuuauuggcugguaaugccuucacggcugguaaaauaauuauuaguugcauacccccuggcuuuguugcacaaaauauuucuaucgcucaggcuacuauguucccccaugucauagcugauguuaggguuuuggaacccauugaggugccauuggaagaugugaggaaugugcuguuccauaacaaugacaacacaccaaccaugagguuggugugcaugcucuacacccccuugcgagccaguggcagcucgucuggaacugaccccuuugugauugcugggcguguuuugacaugcccgagcccugauuuuagcuuuuuguuuuuggucccccccaauguagaacaaaagacuaaaccuuuuagugucccaaaucuuccauugaauacucuuucaaauucgagagucccuucucuaaucaaaucaaugaugguauccagggaccaugggcagaugguucaguuucaaaaugguagggucacccuagaugggcaacugcaaggcaccacgcccacaucagcuagccagcugugcaaaaucaggggcagugucuuccaugcuaauggugggaauggguauaaccuaacagaacuggaugggagcccauaccaugcauuugagagccccgcaccaauaggguuuccagaccuaggugaaugugacuggcacauggaggcuuccccuaccacccaauucaauacuggugauguuauaaaacaaaucaaugucaaacaagaaucagcauuugccccccaccuugguacuauacaggcagacggccugagugaugugagugucaacaccaacaugauagcuaaauuagaaugggugucacccgucagugauggacacaaaggagaugucgauccgugggucaucccacgcuaugggucgacuuugacugaggccgcccaauuagccccuccaauauaucccccagguuuuggugaggccauuguguuuuucaugucagauuucccuauugcccaugguaccaauggcuugagugugccuugcaccauaccccaagaauuugucacccauuuugucaaugaacaggccccuacuagaggggaagcagcccuauuacauuauuuggauccugauacucauagaaaucuuggugaauuuaaauuauauccugauggcuucaugacgugugugccuaacucuaguggcacugguccacaaacucuuccaaucaauggugucuuuguuuuuguguccuggguuuccagauuuuaucaauuaaagccugugggaacagccggcccggcucguaggcuuuaa

SEQ ID NO: 6963 - RNA, 1623 nt, Artificial Sequence
  VP1__Norovirus_and/or_Norovirus-like__AF145709
augaugauggcgucuaaggacgccccaccaaacauggauggcaccaguggugccggccagcugauaccagaggcaaauacagcugagccuauaucaauggagccuguggcuggggcagcaacagcugccgcaaccgcuggccaaguuaauaugauugaccccuggauaaugaauaauuaugugcaagccccucaaggugaauucacuauaucgccuaauaacacaccaggugauauuuuguuugaucuacaauuaggcccccaucucaauccuuucuuaucccauuuggcccaaauguauaacgguuggguuggcaacaugaaaaugaaaguccuauuggcugguaaugccuucacggcugguaaaauaauuauuaguugcauacccccuggcuuugcugcgcaaaacaucucuauugcucaggcuacaauguucccccacgucauagcugauguuaggguuuuggaacccauugaggugccacuggaagaugugaggaaugugcuguuccacaacaaugacaacacaccaaccaugagguuggugugcaugcucuacacccccuugcgagccaguggcagcucaucuggaacugacccuuuugugauugcugggcguguuuugacaugcccaagcccugauuuuagcuucuuguucuuggucccccccaauguagaacaaaagacuaaaccuuuuagugucccaaaucuuccauugaacacccuuucaaauucaagagucccuucucuaauuaaaucaaugaugguguccagggaccaugggcagaugguucaguuucaaaacgguagggucacccuagaugggcaacugcaaggcaccacgcccacaucagcuagccagcugugcaaaaucagaggcagugucuuccaugcuaauggugggaauggauauaaccuaacugcacuggaugggagcccauaccaugcauuugagagcccugcgccaauaggguuuccagaucugggugagugugauuggcacauggaggccuccccuaccacccaauuugauacuggcgauguuauaaagcaaauuaaugucaaacaagaaucagcauuugcuccccaccuugguacuauacaagcagacggccugagugaugugagugucaacacuaacaugauagcuaaauuaggaugggugucacccgucagugauggacauagaggaaaugucgauccguggguuauuccacgauaugggucgacuuugacugaggccgcccaauuagccccuccaauauaucccccagguuuuggugaggccauuguguuuuucaugucagauuuuucuauugcccaugguacuaauggcuugagugugccuugcaccauaccccaagaauuugucacccauuuugucaaugaacaggccccuacuagaggggaagcagcccuauugcauuauuuagauccugacacccauagaaaucuaggcgaguuuaaauuauacccugagggcuucaugacgugugugccuaauuccaguggcacugguccacaaacccucccaaucaaugguguuuuuguuuuuguguccuggguuuccagauucuaucaguuaaagccugugggaacagccggcccggcucguaggcuuuaa

SEQ ID NO: 6964 - RNA, 1623 nt, Artificial Sequence
  VP1__Norovirus_and/or_Norovirus-like__FJ711163
augaugauggcgucuaaggacgccccaacaaacauggauggcaccaguggugccggccagcugguaccagaggcaaauacagcugagccuauaucaauggagccuguggcuggggcagcaacagcugccgcaaccgcuggccaaguuaauaugauugaccccuggauaaugaauaauuaugugcaagccccucaaggugaauucacuauaucacccaauaacacaccaggugauguuuuguuugauuugcaauuaggcccccaccuuaacccuuucuugucccauuuggcccaaauguauaaugguuggguuggcaacaugaaagugaagguccuauuggcugguaaugccuucacggcugguaaaauaauuauuagcugcauacccccuggcuuugcugcacaaaauuucucuauugcucaagcuacaauguucccccacgucauagcugauguuagaguccuggaacccauugaggugccauuggaagaugugaggaaugugcuguuucauaacaaugacaacacaccaaccaugagauugguaugcaugcuuuacaccccccugcgagccagugguagcucaucugggacugacccuuuugugauugcagggcgcguuuuaacaugcccaagcccugauuuuagcuucuuauuuuuggucccccccaauguagaacaaaagaccaaacccuuuagugucccaaaucuuccauugaauacucuuucaaauucaagagucccuucucuaaucaaaucaaugaugauaucuagagaucaugggcagaugguccaguuucaaaaugguagagucacacuggaugggcaacugcaaggcaccacgcccacgucagcuagccagcuguguaaaaucagaggcagugucuuccaugcuaauggugggaauggguacaaccuaacugagcuggaugggagcccauaccaugcauuugagagcccugcgccaauaggguuuccagaucuaggugaaugugauuggcauauggaggccucccccaucacccaauucgauacuggugaugucauaaaacaaauuaaugucaagcaagaaucagcauuugccccccaccuugguacggugcaagcggacggccugagugaugugagugccaacacuaauaugauagcuaaauugggauggguaucacccgucagugauggacauaggagugaugucgauccgugggucaucccacgauaugggucgacuuugacugaggccgcccaguuggccccuccaauauaccccccagguuuuggugaagccauuguguucuuuaugucagauuucccuauugcccauggcacuaauggcuugagcgugcccugcaccauaccccaagaauuuguuacccauuuugucaaugaacaagccccuacuagaggggaagcagcccugcuacauuauuuagacccugacacucacagaaaccuuggugaguuuaaauuguacccugaugguuucaugacauguguaccuaauucuaguggcacugguccacaaacccucccaaucaauggugucuuugucuuuguguccuggguuuccagauucuaccaguuaaagccugugggaacagccggcccggcucguaggcuuuaa

SEQ ID NO: 6965 - RNA, 1623 nt, Artificial Sequence
  VP1__Norovirus_and/or_Norovirus-like__FJ711164
augaugauggcgucuaaggacgccccaacaaacauggauggcaccaguggugccggccagcugguaccagaggcaaauacagcugagccuauaucaauggagccuguggcuggggcagcaacagcugccgcaaccgcuggccaaguuaauaugauugaccccuggauaaugaauaauuaugugcaagccccucaaggugaauucacuauaucacccaauaacacaccaggugauguuuuguuugauuugcaauuaggcccccaccuuaacccuuucuugucccauuuggcccaaauguauaaugguuggguuggcaacaugaaagugaagguccuauuggcugguaaugccuucacggcugguaaaauaauuauuagcugcauacccccuggcuuuguugcacaaaauuucucuauugcucaagcuacaauguucccccacgucauagcugauguuagaguccuggaacccauugaggugccauuggaagaugugaggaaugugcuguuucauaacaaugacaacacaccaaccaugagauugguaugcaugcuuuacaccccccugcgagccggugguagcucaucugggacugacccuuuugugauugcagggcgcguuuuaacaugcccaagcccugauuuuagcuucuuauuuuuggucccccccaauguagaacaaaagaccaaacccuuuagugucccaaaucuuccauugaauacucuuucaaauucaagagucccuucucuaaucaaaucaaugaugauaucuagagaucaugggcagaugguccaguuucaaaaugguagagucacacuggaugggcaacugcaaggcaccacgcccacgucagcuagccagcuguguaaaaucagaggcagugucuuccaugcuaauggugggaauggguacaaccuaacugagcuggaugggagcccauaccaugcauuugagagcccugcgccaauaggguuuccagaucuaggugaaugugauuggcauauggaggccucccccaccacccaauucgauacuggugaugucauaaaacaaauuaaugucaagcaagaaucagcauuugccccccaccuugguacggugcaagcggacggccugagugaugugagugccaacacuaauaugauagcuaaauugggauggguaucacccgucagugauggacauaggagugaugucgauccgugggucaucccacgauaugggucgacuuugacugaggccgcccaguuggccccuccaauauaccccccagguuuuggugaagccauuguguucuuuaugucagauuucccuauugcccauggcacuaauggcuugagcgugcccugcaccauaccccaagaauuuguuacccauuuugucaaugaacaagccccuacuagaggggaagcagcccugcuacauuauuuagacccugacacucacagaaaccuuggugaguuuaaauuguacccugaugguuucaugacauguguaccuaauucuaguggcacugguccacaaacccucccaaucaauggugucuuugucuuuguguccuggguuuccagauucuaccaguuaaagccugugggaacagccggcccggcucguaggcuuuaa

SEQ ID NO: 6966 - RNA, 1623 nt, Artificial Sequence
  VP1__Norovirus_and/or_Norovirus-like__AF414405
augaugauggcgucuaaggacgccccaccaaacauggauggcaccaguggugccggccagcugguaccagaggcaaauacagcugagccuauaucaauggagccuguggcuggggcagcaacagcugccgcaaccgcuggccaaguuaauaugauugaccccuggauaaugaauaauuaugugcaagccccucaaggugaauucacuauaucgccuaacaauacaccaggugauauuuuguuugaucuacaauuaggcccccaucucaauccuuucuuaucccauuuggcccaaauguauaaugguuggguuggcaauaugaaagugaagguccuauuggcugguaaugccuucacggcugguaaaauaauuauuaguugcauacccccuggcuuugcugcacaaaacaucucuauugcucaggcuacaauguucccccacgucauagcugacguuaggguuuuggaaccuauugaggugccauuggaagaugugaggaaugugcuguuccacaacaaugacaacacaccaaccaugagguuggugugcaugcucuacacccccuugcgagccaguggcagcucaucuggaacugacccuuuugugauugcugggcguguuuugacaugcccaagcccugauuuuagcuucuuguucuuggucccccccaauguagaacaaaagacuaaaccuuuuagugucccaaaucuuccauugaauacccuuucaaauucaagagucccuucucuaauuaaaucaaugaugguauccagagaccaugggcagaugguucaguuucaaaacgguagggucacccuagaugggcaacugcaaggcaccacgcccacaucagcuagccagcugugcaaaaucagaggcagugucuuccaugcuaauggugggaauggauauaaccuaacugaacuggaugggagcccauaccaugcauuugagagcccugcgccaauaggguuuccagaucugggugagugugauuggcacauggaggccuccccuacuacccaauucgauacuggugauguuauaaagcaaauuaaugucaaacaagaaucagcauuugcuccccaccuugguacuauacaagcaggcggccugagugaugugagugucaacacuaacaugauagcuaaauuaggaugggugucacccgucagugauggacauagaggaaaugucgauccgugggucauuccacgauacgggucgacuuugacugaggccgcccaauuagccccuccaauauaucccccagguuuuggugaggccauuguguuuuucaugucagauuuuccuauugcccaugguaccaauggcuugagugugccuuucaccauaccccaagaauuugucacucauuuugucaaugaacaggcccccacuagaggggaagcagcccuacuguauuauuuagauccugacacccauagaaaucuaggugaguuuaaauuauauccugagggcuucaugacgugugugccuaauuccaguggcacugguccacaaacccucccaaucaaugguguuuuuguuuuuguguccuggguuuccagauucuaucaguuaaagccugugggaacagccggcccggcucguaggcuuuaa

SEQ ID NO: 6967 - RNA, 1623 nt, Artificial Sequence
  VP1__Norovirus_and/or_Norovirus-like__AB022679
augaugauggcgucuaaggacgcuacaccaagcgcagauggcgccacuggcgccggccagcugguaccggagguuaauacagcugaccccauaccuauugacccuguggcuggcuccucuacagcccuugccacagcaggccagguuaauuugauugaucccuggauaaucaauaauuuugugcaagccccccagggcgaguucacaauauccccaaauaauacccccggugaugugcuuuuugauuugcaauuaggaccccauuuaaauccuuuccuuucccaccuuucucagauguauaaugguugggugggcaacaugcgagugcguguugucuuggcugguaaugcuuucacggcugggaagguuauaauuuguuguguccccccugguuuccaaucucgcacccuuucuauagcccaggcuacuuuauuuccccauguaauugcugauguuaggacccuugacccuguagaagugccccuugaagauguuaggaauguguuguaucauaauaaugacacccaacccaccaugcgccuccuuugcauguuguacacuccucuccgcaccgggggagcgucuggugggacugauucuuuugugguggcugggcguguacucacuuguccgggcccugacuuuaacuucuuauuccuagucccucccacagucgagcaaaagacccgcccuuuuacugugccuaauaucccuuugaaguaccugucuaauuccaggaucccaaauccuauugaagguaugucauugucaccugaccagacccaaaauguucaauuccagaaugguagguguacaauugacggucaaccccuugggaccacaccugucucaguuagucaguuauguaaguuuagggguaggauuacaucuggacagagagugcucaacuugacagaguuggaugguucaccuuuuaugggcuuuggcgcccccgccccugcgggcuuuccagaucuuggguccugugauuggcauauugaaaugaguaaaaucccaaauuccagcacccagaacaacccaauagugaccaauucugucaaacccaauagucaacaguuugucccacacuugucaaguaucacccuugaugaaaauguuuccaguggaggugacuauauuggcacuauacaauggaccucaccuccuucugauucuggcggggccaauacaaauuuuuggaaaaucccugacuauggguccagccuagcagaagcuucacaacuggcccccgcugucuauccaccugguuucaaugaggugauuguguauuuuauggcaucuauaccuggucccaaucagucugggucuccuaauuuagugccaugccugcucccccaggaauauauaacacacuuuauuagugagcaggcccccauccagggugaggcugccuuacuccacuauguagacccagacaccaaucgcaauuugggugaguucaaauuauauccuggugguuauuuaaccuguguuccuaauaguucuaguacuggaccucaacaacuuccucuugaugguguauuugucuuugcuucuuggguuucuagauuuuaucaauuaaagccugugggaacagccggaccggcuagagguaggcuuuaa

SEQ ID NO: 6968 - RNA, 1623 nt, Artificial Sequence
  VP1__Norovirus_and/or_Norovirus-like__AF414403
augaugauggcgucuaaggacgccccaccaaacauggauggcaccaguggugccggccagcugguaccagaggcaaauacagcugagccuauaucaauggagccuguggcuggggcagcaacagcugccgcaaccgcuggccaaguuaauaugauugaccccuggauaaugaauaauuaugugcaagccccucaaggugaauucacuauaucgccuaacaauacaccaggugauauuuuguuugaucuacaauuaggcccccaucucaauccuuucuuaucccauuuggcccaaauguauaaugguuggguuggcaauaugaaagugaagguccuauuggcugguaaugccuucacggcugguaaaauaauuauuaguugcauacccccuggcuuugcugcacaaaacaucucuauugcucaggcuacaauguucccccacgucauagcugacguuaggguuuuggaaccuauugaggugccauuggaagaugugaggaaugugcuguuccacaacaaugacaacacaccaaccaugagguuggugugcaugcucuacacccccuugcgagccaguggcagcucaucuggaacugacccuuuugugauugcugggcguguuuugacgugcccaagcccugauuuuagccucuuguucuuggucccccccaauguggaacaaaagacuaaaccuuuuagugucccaaaucuaccauugaauacccuuucaaauucaagaguuccuucucuaauuaaaucaaugaugguauccagagaucaugggcagaugguucaguuucaaaacgguagggucgcccuagaugggcaacugcaaggcaccacgcccacaucagcuagccagcugugcaaaaucagaggcagugucuuccaugccaauggugggaauggguacaacccaacugaacuggaugggagcccauaccaugcauuugagagcccugcgccaauaggguuuccagaucuaggugagugugauuggcacauggaggccuccccuaccacccaauucgauacuggugauguuauaaaacaaauuaaugucaaacaagaaucagcauuugcuccccaccuugguacuauacaagcagacggccugagugaugugagugucaauacuaacaugauagcuaaauuaggaugggugucacccgucagugauggacauagaggaaaugucgauccgugggucauuccacgauaugggucgacuuugacugaggccgcccaauuagccccuccaauauaucccccagguuuuggugaggccauuguguuuuucaugucagauuuuccuauugcccaugguaccaauggcuuaagugugccuugcaccauaccccaagaauuugucacucauuuugucaaugaacaggcccccacuagaggggaagcagcccuacugcauuauuuagauccugacacccauagaaaucuuggugaguuuaaauuauacccugagggcuucaugacgugugugccuaauuccaguggcacugguccacaaacccucccaaucaaugguguuuuuguuuuuguguccuggguuuccagauucuaucaguuaaagccugugggaacagccggcccggcucguaggcuuuaa

SEQ ID NO: 6969 - RNA, 1623 nt, Artificial Sequence
  VP1__Norovirus_and/or_Norovirus-like__LC101821
augaugauggcgucuaaggacgcugcaccaagcgcagauggcgccacuggcgccggccagcugguaccggagguuaauacagcugacccuauacccauugacccuguggcugguuccucuacagcacuugccacugcaggccaaguuaauuugauugaucccuggauaaucaauaauuuugugcaagccccccagggugaauucacaauauccccaaacaauacccccggugaugugcuuuuugauuugcaguuaggaccucauuuaaacccuuuccucucccaucucucucagauguacaauggcugggugggcaacaugcgagugcguguugucuuggcugguaaugcuuucacggcugggaagguuauaauuuguuguguccccccuggcuuucaaucucguacucuuuccauagcucaggcuacuuuauucccccacguuauugcugauguuaggacccuugaccccguagaagugccucuugaagaugucaggaacguguuguaucauaauaaugacacccaacccaccaugcgccuccuuugcaugcuguauaccccucuccgcaccggaggagcgucuggugggacugauucuuucgugguagcugggcguguacuuacuugcccaggcccugacuuuaauuucuuauucuuggucccuccuacagucgagcaaaagacucgcccauucacugugccuaauaucccuuugaaguaucugucuaacuccagaaucccaaaccccauugaagguaugucauugucaccugaucagacucaaaauguccaauuccaaaauggcaggugcacaauugacggucaaccccucgggacuacaccugucucgguuagccaguuauguaaguuuagggguaggauuacaucuggacagaaggugcucaauuugacagaguuggaugguucaccuuuuauggccuuugcugccccugccccugugggcuucccagaucuuggguccugugauuggcauauugagaugaguaaaaucccaaauucuagcacccagaguaauccaauaguggucaauucugucaagcccaauagucaacaguuugucccucacuugucaagcauuacccuugaugacaauguuucuagugggggugauuauauugguacuauacaauggaccucuccuccuucugguucuggcggagccaauacaaacuuuuggaaaaucccugacuaugggucuagcuuggcugaagcuucacaguuggcccccgcugucuauccaccugguuucaaugaagugauuguguauuuuauggcaucuauaccuggccccaaucaaucuggguccccuaacuuggugccaugccuacucccccaggaauauauaacacauuucauuagugagcaggcccccauucagggugaggcugccuuacuccauuauguggacccagauaccaaucguaauuugggugaguuuaaauuguauccuggugguuauuuaaccuguguuccuaauaguucuaguacuggaccucaacagcuuccucuugaugguguuuuugucuuugcuucuugggucucuagauuuuaucaauuaaagccugugggaacagccggaccggcuagagguaggcuuuaa

SEQ ID NO: 6970 - RNA, 1623 nt, Artificial Sequence
  VP1__Norovirus_and/or_Norovirus-like__AY038598
augaugauggcgucuaaggacgccccaccaaacauggauggcaccaguggugccggccagcugguaccagaggcaaauacagcugagccuauaucaauggagccuguggcuggggcagcaacagcugccgcgaccgcuggccaaguuaauaugauugaccccuggauaauggauaauuaugugcaagccccucaaggugaauucacuauaucgcccaauaacacaccaggugauauuuuguuugaucuacaauuaggcccccaucucaauccuuucuuaucccauuuggcccaaauguauaaugguuggguuggcaauaugaaagugaagguccuauuggcugguaaugccuucacggcuggcaaaauaauuauuaguugcauacccccuggcuuugcggcacaaaacaucuccauugcucaagcuacaauguuuccccacguuauagcugauguuaggguucuagaccccauugaagugccacuggaagaugugggaaaugugcuguuccauaacaauggcgacacaccaaccaugagguuggugugcaugcucuacacccccuugcgagccaguggcagcucgucuggaacugacccuuuugugauugcugggcaugucuugacaugcccaagcccugauuuuagcuuuuuauucuugggcccccccaauguagaacaaaagacuaaaccauuuagugucccaaaucuuccauugaauacccuuucaaauucaagagucccuucucuaauuaggucaaugaugguguccagagaccaugggcagaugguucaguuucaaaaugguagggucacccuagaugggcagcugcaaggcaccacgcccacaucagcuagccaacugugcaaaaucagaggcagugucuuccacgccaauggugggaauggguauacccuaacugaacuggaugggagcccauaccaugcauuugagagcccugcgccaauaggguuuccagauuugggugagugugauuggcacauggaggcauccccuaccacccaauucgauacuggugauguuauaaagcaaauuaaugucaaacaagaagcagcauuugcuccccaccuugguacuauacaagcagacggccugagugaugugagugucaacacuaacaugauagcuaaauuaggaugggugucacccgccagugauggacauagaggaaaugucgauccgugggucauuccacgauacgggucgacuuugacugaggccgcccaacuagccccuccaauauaucccccagguuuuggugaggccauuguguuuuucaugucagauuucccuauugcccauggugccaauggcuugagugugccuugcaccauaccccaagaguuugucacucauuuugucaaugaacaggccccuacuagaggggaagcagcccuacugcauuauuuagauccugacacccauagaaaucuaggugaguucaaauuauauccugagggcuucaugacgugugugccuaauuccaguggcacugguccacaaacccucccaaucaaugguguuuuuguuuuuguguccuggguuuccagauucuaucaguuaaagccugugggaacagccggcccggcucguagccuuuaa

SEQ ID NO: 6971 - RNA, 1623 nt, Artificial Sequence
  VP1__Norovirus_and/or_Norovirus-like__KJ196292
augaugauggcgucuaaggacgccccaacaaacauggauggcaccaguggugccggccagcugguaccagaggcaaacacagcugagccuauaucaauggagcccguggcuggggcagcaacagcugccgcaaccgcuggccaaguuaauaugauugaccccuggauaaugaauaauuaugugcaagccccucaaggugaauucaccauaucgccuaacaacacaccaggugauauuuuguuugauuuacaauuaggcccccaccuuaacccuuucuuaucccauuuggcccaaauguauaauggcuggguuggcaauaugaaagugaagguuuuauuggcugguaaugccuucacggcugguaaaauaaucauuagcuguauacccccuggcuuuguugcacaaaauguuucuaucgcucaagcuacuauguucccccauguuauagcugaugucagaguuuuggaacccauugaggugccauuggaagaugugaggaaugugcuguuccacaacaaugacaacacaccaaccaugagguuggugugcaugcucuacacccccuugcgagcuaguggcagcucgucuggaacugaccccuuugugauugcugggcguguuuugacaugcccgagccccgauuuuagcuuuuuguuuuuggucccccccaauguagaacaaaagacuaaaccuuuuagugucccaaaucuuccauugaauacucuuucaaauucgagaguccccucucuaauuaaaucaaugaugguauccagggaccaugggcagaugguucaguuucaaaaugguagggucacccuagaugggcaacugcaaggcaccacgcccacaucagcuagccagcuguguaaaaucaggggcagugucuuccaugcuaauggugggaauggguauaaccugacagaauuggaugggagcccauaccaugcauuugaaagccccgcaccaauaggguuuccagauuuaggugaaugugacuggcacauggaggcuuccccuaccacccaauucaauacuggugauguuauaaaacaaauuaaugucaaacaagaaucagcauuugccccccaccuugguaccauacaggcagacggccugagugaugugagugucaacacuaacaugauagcuaaauugggaugggugucacccgucagugauggacacaaaggagaugucgacccgugggucauuccacgcuaugggucgacuuugacugaggcugcccaauuagccccuccaauauaccccccaggcuuuggugaggccauuguguuuuucaugucggacuucccuauugcccaugguacuaauggcuugagugugccuugcaccauaccccaagaauuugucacccauuuugucaaugaacaggccccuacuagaggggaagcagcccuauuacauuauuuggauccugacacucauaggaaucuuggugaauucaaauuauauccugauggcuucaugacgugugugccuaauuccagugguacuggcccacaaacucucccaaucaauggugucuuuguuuuuguguccuggguuuccagauuuuaucaauuaaagccugugggaacagccggcccggcucguaggcuuuaa

SEQ ID NO: 6972 - RNA, 1623 nt, Artificial Sequence
  VP1__Norovirus_and/or_Norovirus-like__JQ743331
augaugauggcgucuaaggacgcuacaccaagcgcagauggcgccacuggcgccggccagcugguaccggagguuaauacagcugacccuauacccauugacccuguggcuggcuccucuacagcacuugccacugcaggccagguuaauuugauugaucccuggauaaucaauaauuuugugcaagccccccagggugaauucacaauauccccaaauaauacccccggugaugugcuuuuugauuugcaguuaggaccucauuuaaacccuuuccucucccaucucucucagauguauaauggcugggugggcaacaugcgaguucguguugucuuggcugguaaugcuuuuacggcugggaagguuauaauuuguuguguccccccugguuuucaaucucgcacucuuuccauagcucaggccacuuuauuuccccacgucauugcugauguuaggacccuugacccuguagaagugccucuugaagaugucaggaauguguuguaucauaauaaugacacccaaccuaccaugcgccuccuuugcauguuguacacuccucuccgcaccgggggagcguccggugggacugauucuuucgugguagcugggcgugugcuuacuugcccaggcccugacuuuaacuucuuauucuuagucccuccuacagucgagcaaaagacucgcccuuucacugugccuaauaucccuuugaaguaucugucuaacuccagaaucccaaaccccauugaagguaugucauugucaccugaccagacucaaaauguccaauuccagaauggcaggugcacaauugacggucaaccccucgggaccacaccugucucgguuagccaguuauguaaguuuagggguaggauuacaucuggacagaaggugcucaauuugacagaguuggaugguucaccuuuuauggccuuugcugccccugccccugcgggcuucccagaucuuggguccugugauuggcauauugagaugaguaaaaucccaaauucuagcacccagaguaauccaauaguggucaauucuguuaagcccaauagucaacaguuugucccacacuugucaagcaucacccuugaugauaauguuucuagugggggugauuauauugguacuauacaauggaccucuccuccuucugauucuggcggagccaauacaaacuuuuggaaaaucccugacuaugggucuagccuggcugaagcuucacagcuggcccccgcugucuauccaccugguuuuaaugaggugauuguguauuuuauggcaucuauaccuggccccaaucaaucugggucccccaacuuggugccaugccuacucccccaggaauauauaacacauuucauuagugagcaggcccccauucagggugaggcugccuuacuccauuauguggacccagacaccaaucguaauuugggugaguuuaaauuguauccuggugguuauuuaaccuguguuccuaauaguucuaguacuggaccucagcagcuuccucuugaugguguauuugucuuugcuucuuggguuucuagauuuuaucaauuaaagccugugggaacagccggaccggcuagagguaggcuuuaa

SEQ ID NO: 6973 - RNA, 1623 nt, Artificial Sequence
  VP1__Norovirus_and/or_Norovirus-like__EF547394
augaugauggcgucuaaggacgcuacaccaagcgcagauggcgccacuggcgccggccagcugguaccggagguuaauacagcugacccuauacccauugacccuguggcuggcuccucuacagcacuugccacugcaggccagguuaauuugauugaucccuggauaaucaauaauuuugugcaagccccccagggugaauucacaauauccccaaauaauacccccggugaugugcuuuuugauuugcaguuaggaccucauuuaaacccuuuccucucccaucucucucagauguauaauggcuggguaggcaacaugcgagugcguguugucuuggcugguaaugcuuucacggcugggaagguuauaauuugcuguguccccccugguuuucaaucucgcacucuuuccauagcucaggcuacuuuauuuccccacgucauugcugauguuaggacccuugacccuguagaagugccucuugaagauguuaggaauguguuguaucauaauaaugacacccaaccuaccaugcgccuccuuugcauguuguacacuccucuccgcaccgggggagcgucuggugggacugauucuuucgugguagcugggcgugugcuuacuugcccaggcccugacuuuaacuucuuauucuuagucccuccuacagucgagcaaaagacucgcccuuucacugugccuaauaucccuuugaaguaucugucuaacuccagaaucccaaaccccauugaagguaugucauugucaccugaccagacucaaaauguccaauuccagaauggcaggugcacaauugacggucaaccccucgggaccacaccugucucgguuagccaguuauguaaguuuagggguaggauuacaucuggacagaaggugcucaauuugacagaguuggaugguucaccuuuuauggccuuugcugccccugccccugcgggcuucccagaucuuggguccugugauuggcauauugaggugaguaaaaucccaaauucuagcacccagaguaauccaauaguggucaauucugucaagcccaauagucaacaguuugucccacacuugucaagcaucacccuugaugacaauguuucuagugggggugauuauauugguacuauacaauggaccucuccuccuucugauucuggcggagccaauacaaacuuuuggaaaaucccugacuaugggucuagccuggcugaagcuucacagcuggcccccgcugucuauccaccuggcuuuaaugaggugauuguguauuuuauggcaucuauaccuggccccaaucaaucuggguccccuaacuuggugccaugccuacucccccaggaauauauaacgcauuucauuagugagcaggcccccauucagggugaggcugccuuacuccauuauguggacccagacaccaaucguaauuugggugaguuuaaauuguauccuggugguuauuuaaccuguguuccuaauaguucuaguacuggaccucagcagcuuccucuugaugguguauuugucuuugcuucuuggguuucuagauuuuaucaauuaaagccugugggaacagccggaccggcuagagguaggcuuuaa

SEQ ID NO: 6974 - RNA, 1623 nt, Artificial Sequence
  VP1__Norovirus_and/or_Norovirus-like__AF394960
augaugauggcgucuaaggacgcuacaccaagcgcagauggcgccacuggcgccggccagcugguaccggagguuaauacagcuggcccuauacccauugacccuguggcuggcuccucuacagcacuugccacugcaggccagguuaauuugauugaucccuggauaaucaauaauuuugugcaagccccccagggcgaauucacaauauccccaaauaauacccccggugaugugcucuuugauuugcaguuaggaccucauuuaaacccuuuccucucccaucucucucagauguauaauggcugggugggcaacaugcgagugcguguugucuuggcugguaaugcuuucacggcugggaagguuauaauuugcuguguccccccugguuuucaaucucgcacucuuuccauagcucaggcuacuuuauuuccccacgucauugcugauguuaggacccuugacccuguagaagugccucuugaagaugucaggaauguguuguaucauaauaaugacacccaaccuaccaugcgccuccuuugcauguuguacacuccucuccgcacugggggagcgucuggugggacugauucuuucgugguagcugggcguguacucacuuguccaggcccugacuuuaacuucuuauucuuagucccuccuacagucgagcaaaagacucgcccuuucacugugccuaauaucccuuugaaguaucugucuaacuccagaaucccaaaccccauugaagguaugucauugucaccugaccagacccaaaauguccaauuccagaauggcagguguacaauugacggucaaccccucgggaccacaccugucucgguuagccaguuauguaaguuuagggguaggauuacaucuggacagaaggugcucaauuugacagaguuggaugguucaccuuuuauggccuuugcugccccugccccugcgggcuucccagaucuuggguccugcgauuggcauauugagaugaguaaaaucccaaacucuagcacccagagcaauccaauaguggucaauucugucaagcccaauagucaacaguuugucccacacuugucaagcaucacccuugaugacaauguuucuagugggggugauuauauugguacuauacaauggaccucuccuccuucugauucuggcggagccaauacgaauuuuuggaaaaucccugacuaugggucuagccuggcugaagcuucacagcuggcccccgcugucuauccaccugguuuuaaugaggugauuguguauuuuauggcaucuauaccuggccccaaucaaucuggguccccuaacuuggugccaugccuacucccccaggaauauauaacacacuucauuagugagcaggcccccauucagggugaggcugccuuacuccauuauguggacccagacacuaaucguaauuugggugaguuuaaauuguauccuggugguuauuuaaccuguguuccuaauaguucuaguacuggaccucagcagcuuccucuugaugguguauuugucuuugcuucuuggguuucuagauuuuaucaauuaaagccugugggaacagccggaccggcuagagguaggcuuuaa

SEQ ID NO: 6975 - RNA, 1623 nt, Artificial Sequence
  VP1__Norovirus_and/or_Norovirus-like__AJ277616
augaugauggcgucuaaggacgcuacaccaagcgcagauggcgccacuggcgccggccagcugguaccggagguuaauacagcugacccuauacccauugacccuguggcuggcuccucuacagcacuugccacugcaggccagguuaauuugauugaucccuggauaaucaauaauuuugugcaagccccccagggcgaauucacaauauccccaaauaauacccccggugaugugcuuuuugauuugcaguuaggaccucauuuaaacccuuuccucucccaucucucucagauguauaauggcugggugggcaacaugcgagugcguguugucuuggcugguaaugcuuucacggcugggaagguuauaauuugcuguguucccccugguuuucaaucucgcacucuuuccauagcucaggcuacuuuguuuccccacgucauugcugauguuaggacccuugauccuguagaagugccucuugaagaugucaggaauguguuguaucauaauaaugacacccaaccuaccaugcgccuccuuugcauguuguacacuccucuccgcaccgggggagcgucuggugggacugauucuuucgugguagcugggcgugugcuuacuugcccaggcccugacuuuaacuucuuauucuuagucccuccuacagucgagcaaaagacucgcccuuucacugugccuaauaucccuuugaaguaccugucuaauuccagaaucccaaaucccauugaagguaugucauugucaccugaccagacccaaaauguucaauuccagaaugguaggugcacaauugacggucaaccccucgggaccacaccugucucgguuagccaguuauguaaguuuagggguaggauuacaucuggacagaaggugcucaauuugacaaaguuggaugguucaccuuuuauggcuuuugcugccccugccccugcgggcuucccaaaucuuggguccugugauuggcauauugagaugaguaaaaucccaaauucuagcacccagaguaauccaauaguggucaauucugucaagcccaauagucaacaguuugucccacacuugucaagcaucacccuugaugaaaauguuucuagugggggugauuauauugguacuauacaauggaccucuccuccuucugauucuggcggagccaauacaaacuuuuggaaaaucccugacuaugggucuagccuagcagaagcuucacagcuggcccccgcugucuauccacugguuuuuaaugaggugauuguguauuucauggcauguauacguggccccaaucaauguggguccccuaacuuggugccaugcuuauccccccaggaauauauaacacacuucauuagugagcaggcccccauucagggugaggcugccuuacuccauuauguagacccagacaccaaucguaauuugggugaguuuaaacuguauccuggugguuauuuaaccuguguuccuaauaguucuaguacuggaccucagcagcuuccucuugaugguguauuugucuuugcuucuuggguuucuagauuuuaucaauuaaagccugugggaacagccggaccggcuagagguaggcuuuaa

SEQ ID NO: 6976 - RNA, 1623 nt, Artificial Sequence
  VP1__Norovirus_and/or_Norovirus-like__GQ413970
augaugauggcgucuaaggacgcuacaccaagcgcagauggcgccacuggcgccggccagcugguaccggagguuaauacagcugacccuauacccauugacccuguggcuggcuccucuacagcccuugccacugcgggccaaguuaauuugauugaucccuggauaaucaauaauuuugugcaagccccucagggcgaguucacaauauccccaaauaauacccccggugaugugcuauuugauuugcaguuagggccucaucugaauccuuuccuuucccaucuuucucagauguacaauggcugggugggcaacaugcgaguacguguuguuuuggcugguaaugcuuuuacagcuggaaagguuauaauuuguuguguucccccuggcuuucaaucucgcacucuuuccauagcucaggcuacucuauuuccccaugucauugcugauguuaggacccuugauccuguagaagugccccuugaagauguuaggaauguguuguaucauaauaaugacacccaaccuaccaugcgccuccuuugcauguuguacaccccucuucgaacugggggggcgucuggugggacugauucuuuugugguagcuggacgugugcuuacuugcccaggcccugacuuuaacuucuuauuccuaguuccucccacagucgagcaaaagacucgcccuuuuacugugccuaauaucccuuugaaguaucugucuaauucuaggaucccaaacccuauugaggguaugucuuugucaccugaccagacccaaaauguucaauuccagaaugguagguguacaauugacggucagccccucgggaccacaccugucucaguuagccaguuauguaaguuuagggguaggauuacaucuggacagagggugcucaauuugacagaguuagaugguucaccuuuuauggccuuugccgcccccgcccccgcgggcuuuccagaucucggaucuugugauuggcauauugaaaugaguaagauuccaaacuccagcacccagaacaauccaauaguaguuaauucugucaaacccaauagucaacaguuugucccgcauuugucaaguaucacccuugaugauaauguuucuagugggggugacuauauuggcacuauacaauggaccucuccuccuucugauuccggcggagccaacacaaauuuuuggaagauuccugacuaugggucuagccuagcagaagccucacagcuggcccccgcuguuuauccgccugguuucaaugaggugauuguguacuuuauggcaucuauaccuggucccaaucaaucugguucccccaauuuggugccaugccuucucccccaggaauauauaacacauuuuaucagugagcaggcccccauucagggugaggcugccuuacuccauuauguagacccagacaccaaucguaauuugggugaauucaaguuguauccuggugguuaucugacuuguguuccuaauaguucuaguacaggaccucaacagcuuccucuugaugguguguuugucuuugcuucuuggguuucuagauuuuaucaauuaaagccugugggaacagccggaccggcuagagguaggcuuuaa

SEQ ID NO: 6977 - RNA, 1623 nt, Artificial Sequence
  VP1__Norovirus_and/or_Norovirus-like__KT732281
augaugauggcgucuaaggacgcuacaccaagcgcagauggcgccacuggcgccggccagcugguaccggagguuaauacagcugacccuauacccauugacccuguggcuggcuccucuacagcacuugccacugcaggccaaguuaauuugauugaucccuggauaaucaauaauuuugugcaagccccccagggugaauucacaauauccccaaacaauacccccggugaugugcuuuuugauuugcaguuaggaccucauuuaaacccuuuccucucccaucucucucagauguacaauggcugggugggcaacaugcgagugcguguugucuuggcugguaaugcuuucacggcugggaagguuauaauuuguuguguccccccuggcuuucaaucucguacucuuuccauagcucaggcuacuuuauucccccacguuauugcugauguuaggacccuugacccuguagaagugccucuugaagaugucaggaacguguuguaucauaauaaugacacccaacccaccaugcgccuccuuugcaugcuguacaccccucuccgcaccgggggagcgucuggugggacugauucuuucgugguagcugggcguguacuuacuugcccaggcccugacuuuaacuucuuauucuuggucccuccuacagucgagcaaaagacucgcccuuucacugugccuaacauuccuuugaaguaucugucuaacuccagaaucccaaaccccauugaagguaugucauugucaccugaucagacucaaaacguccaauuccaaaauggcaggugcacaauugacggucaaccccucgggacuacaccugucucgguuagccaguuauguaaguuuagggguaggauuacaucuggacagaaggugcucaauuugacagaguuggaugguucaccuuuuauggccuuugcugccccugccccugcgggcuucccagaucuuggguccugugauuggcauauugaggugaguaaaaucccaaauucuagcacccaggguaauccaauaguggucaauucugucaagcccaauagucaacaguuugucccucacuugucaagcauuacccuugaugacaauguuucuagugggggugauuauauugguacuauacaauggaccucuccuccuucugauucuggcggagccaauacaaacuuuuggaaaaucccugacuaugggucuagcuuggcugaagcuucacaguuggcccccgcugucuauccaccugguuucaaugaagugauuguguauuuuauggcaucuauaccuggccccaaucaaucuggguccccuaacuuggugccaugccuacucccccaggaauauauaacacauuucauuagugagcaggcccccauucagggugaggcugccuuacuccauuauguggacccagacaccaaucguaauuugggugaguuuaaauuguauccuggugguuauuuaaccuguguuccuaauaguucuaguacuggaccucaacagcuuccucuugaugguguuuuugucuuugcuucuugggucucuagauuuuaucaauuaaagccugugggaacagccggaccggcuagagguaggcuuuaa

SEQ ID NO: 6978 - RNA, 1623 nt, Artificial Sequence
  VP1__Norovirus_and/or_Norovirus-like__AF414404
augaugauggcgucuaaggacgcuacaccaagcgcagauggcgccacuggcgccggccagcugguaccggagguuaauacagcugacccuauaccuauugacccuguggcuggcuccucuacagcccuugccacagcaggccgaguuaauuugauugaucccuggauaaucaauaauuuugugcaagccccccagggcgaguuuacaauauccccaaauaauacccccggugaugugcuuuuugauuugcaguuaggaccucauuuaaacccuuuccucucccaucuuucucagauguauaaugguuggguaggcaacaugcgaguacguguugucuuggcugguaacgcuuucacggcugggaagguuauaauuugcuguguccccccuggcuuucaaucucgcacucuuuccauagcucaggcuacuuuauuuccccauguuauugcugauguuaggacccuugauccuguagaagugccccuugaagaugucaggaaugugcugcaucauaauaaugacacccaaccuaccaugcgccuccuuugcauguuguauacuccucuccgcaccggaggggcgucuggugggacugauucuuuugugguaucugggcgugugcucacuugcccgggcccugauuuuaauuucuuauuccuagucccuccuacagucgagcaaaagacccgcccuuuuacugugccuaauaucccuuugaagugccugucuaauucuaggaucccaaauccuaucgaggguaugucauugucaccugaccagacccaaaauguucaauuccagaaugguagguguacaauugauggucaaccccucgggaccacaccugucucaguuagccaguuguguaaguuuagggguaggauuacaucuggacagggagugcucaauuugacagaguuggaugguucaccuuuuauggccuuugccgcccccgccccugcggguuucccggaucuuggauccugugauuggcauauugaaaugaguaaaaucccaaacucuaguacccagaacaauccaauaguggucaauucugucaaacccaauagucaacaguuugucccacacuugucaagcaucacccuugaugaaaacguuucuagugggggugacuauauugguacuauacaauggaccucuccuccuucugauuccggcggagccaacacaaauuuuuggaaaaucccugacuaugggucuagccuagcagaagcuucacaguuggcccccgcugucuauccaccugguuucaaugaggugaucguguacuuuauggcaucuauacccggucccaaucagucuggguccccuaacuuggugccaugccugcuuccccaggaauauauaacacacuucauuagugagcaggcccccauucagggugaggcugccuuacuccauuauguagacccagacaccaaucguaaccugggugaguuuaaauuguacccuggugguuauuuaaccuguguuccuaauaguucuaguacuggaccucagcagcuuccucuugaugguguauuugucuuugcuucuuggguuucuagauuuuaucaauuaaagccugugggaacagccggaccggcuagagguaggcuuuaa

SEQ ID NO: 6979 - RNA, 1623 nt, Artificial Sequence
  VP1__Norovirus_and/or_Norovirus-like__AF414402
augaugauggcgucuaaggacgcuacaccaagcgcagauggcgccacuggcgccggccagcugguaccggagguuaauacagcugacccuauaccuauugacccuguggcuggcuccucuacagcccuugccacagcaggccaaguuaauuugauugaucccuggauaaucaauaauuuugugcaagccccccagggcgaguuuacaauauccccaaauaauacccccggugaugugcuuuuugauuugcaguuaggaccucauuuaaacccuuuccucucccaucuuucucagauguauaaugguuggguaggcaacaugcgaguacguguugucuuggcugguaacgcuuucacggcugggaagguuauaauuugccguguccccccuggcuuucaaucucgcacucuuuccauagcucaggcuacuuuauuuccccauguuauugcugauguuaggacccuugauccuguagaagugccccuugaagaugucaggaaugugcuguaucauaauaaugacacccaaccuaccaugcgccuccuuugcauguuguauacuccucuccgcaccggaggggcgucuggugggacugauucuuuugugguaguugggcgugugcucacuugcccgggcccugauuuuaauuucuuauuccuagucccuccuacagucgagcaaaagacccgcccuuuuacugcgccuaauaucccuuugaaguaccugucuaauucuaggaucccaaacccuaucgaggguaugucauugucaccugaccagacccaaaauguucaauuccagaaugguagguguacaauugauggucaaccccucggggccacaccugucucaguuagccaguuguguaaguuuagggguaggauuacaucuggacagagagcgcucaauuugacagaguuggaugguucaccuuuuauggccuuugccgcccccgccccugcggguuucccggaucuuggauccugugauuggcauauugaaaugaguaaaaucccaaacucuaguacccagaacaauccaauaguggucaauucugucaaacccaauagucaacaguuugucccgcacuugccaaguaucacccuugaugaaaacguuucuagugggggugacuauauugguacuauacaauggaccucuccuccuucugauuccggcggagccaacacaaauuuuuggaaaaucccugacuaugggucuagccuagcagaagcuucacaguuggcccccgcugucuauccaccugguuucaaugaggugauuguguacuuuauggcaucuauacccggucccaaucagucuggguccccuaacuuggugccaugccugcuuccccaggaauauauaacacacuucauuagugagcaggcccccauucagggugaggcugccuuacuccauuauguagacccagacaccaaucguaaccugggugaguuuaaauuguacccuggugguuauuuaaccuguguuccuaauaguucuaguacuggaccucagcagcuuccucuugaugguguauuuguuuuugcuucuuggguuucuagauuuuaucaauuaaagccugugggaacagccggaccggcuagagguaggcuuuaa

SEQ ID NO: 6980 - RNA, 1623 nt, Artificial Sequence
  VP1__Norovirus_and/or_Norovirus-like__AJ313030
augaugauggcgucuaaggacgcuacaccaagcgcagauggcgcacucggcgccggccagcugguaccggagguuaauacagcugaccccauaccuauugacccuguggcuggcuccuccacggcccuugccacagcaggccagguuaauuugauugaucccuggauaaucaauaauuuugugcaagccccucagggcgaguucacaauauccccaaacaauacccccggugaugugcuuuuugauuuacaauugggaccccauuuaaauccauuccuuucccaccuuucucagauguauaaugguugggugggcaacaugcgagugcguguugucuuggcugguaaugcuuucacggcugggaagguuauaauuuguuguguucccccugguuuccaaucucguacccuuucaauagcccaggcuaccuuauuuccccaugucauugcugauguuaggacccuugacccuguggaagugccccuugaagauguuaggaauguguuguaucauaauaaugacacccaacccaccaugcgccuccuuugcauguuguauacuccucuccgcaccgggggagcgucuggugggacugauucuuuugugguagcugggcguguacucaccugcccaggcccugacuucaacuucuuauuccuagucccucccacaguugagcaaaagacucgcccuuucacuguaccuaacaucccuuugaaguaccugucuaauucuaggaucccaaaucccauugaagguaugucacugucaccugaccaaacccaaaauguucaauuccagagugguagguguacaauugacggucaaccccucgggaccacaccugucucaguuagucaguuguguaaguuuagagguaggauuacaucuggacagaaggugcucaauuugacaggauuggaugguucaccuuucauggccuuugcugcccccgcuccugcgggcuucccagaucuuggguccugugauuggcacauugagaugaguaaaaucccaaauucuagcacccagaacaacccaauagugauuaauucuguuaagcccaauagucaacaguuugucccacauuuaucaaguaucacccuugaugaaaauguucuuagcgggggcgacuauauuggcacuauacaauggaccucuccuccuucugauucuggcggagccaacacaaauuuuuggaaaaucccugacuaugggucuagcuuagcagaagcuucacaacuggcccccgcugucuauccaccugguuuuaaugaggugauuguguauuuuauggcaucuauaccuggucccaaucagucugggucuccuaauuuggugccaugucugcucccucaggaauauauaacacacuuuauuagugagcaggcccccauccagggcgaggcugcccuacuccacuacguggacccagacaccaaucguaauuugggugaguucaaauuguauccuggugguuauuuaaccugugucccuaauagcucuaguacuggaccucaacaacuuccucuugaugguguauuugucuuugcuucuuggguuuccagauuuuaucaauuaaagccugugggaacacgcggaccggcuagagguaggcuuuaa

SEQ ID NO: 6981 - RNA, 1623 nt, Artificial Sequence
  VP1__Norovirus_and/or_Norovirus-like__KM036381
augaugauggcgucuaaggacgcuacaccaagcgcagauggcgccacuggcgccggccagcugguaccggagguuaauacagcugacccuauacccauugacccuguggcuggcuccucuacagcacuugccacugcaggccaaguuaauuugauugaucccuggauaaucaauaauuuugugcaagccccccagggugaauucacaauauccccaaacaauacccccggugaugugcuuuuugauuugcaguuaggaccucauuuaaacccuuuccucucccaucucucucagauguacaauggcugggugggcaacaugcgagugcguguugucuuggcugguaaugcuuucacggcugggaagguuauaauauguuguguccccccuggcuuucaaucucguacucuuuccauagcucaggcuacuuuauucccccacgucauugcugauguuaggacccuugacccuguagaagugccccuugaagaugucaggaacguguuguaucauaauaaugacacccaacccaccaugcgccuccuuugcaugcuguacaccccucuccgcaccgggggggcgucuggugggacugauucuuucgugguagcugggcguguacuuacuugcccaggcccugacuuuaacuucuuauucuuggucccuccuacagucgagcaaaagacucgcccuuucacugugccuaauaucccuuugaaguaucugucuaauuccagaaucccaaaccccauugaaggcaugucauugucaccugaucagacucaaaauguccaauuccagaauggcaggugcacaauugacggucaaccccucgggacuacaccugucucgguuagccaguuauguaaguuuagggguaggauuacaucuggacagaaggugcucaauuugacagaguuggaugguucaccuuuuauggccuuugcugccccugccccugcgggcuucccagaccuuggguccugugauuggcauauugagaugaguaaaaucccaaauucuagcaccgagaguaauccaauaguggucaauucugucaagcccaauagucaacaguuugucccucacuugucaagcaucacccuugaugacaauguuucuagugggggugauuauauugguacuauacaauggaccucuccuccuucugauucuggcggagccaauacaaacuuuuggaaaaucccuaacuaugggucuagcuuggcugaagcuucacaguuggcuccugcugucuauccaccugguuucaaugaagugauuguguauuuuauggcaucuauaccuggccccaaucaaucuggguccccuaacuuggugccaugccuacucccccaggaauauauaacacauuucauuagugagcaggcccccauucagggugaggcugccuuacuccauuauguggacccagacaccaaucguaauuugggugaguuuaaauuguauccuggugguuauuuaaccuguguuccuaauaguucuaguacuggaccucaacagcuuccucuugaugguguuuuugucuuugcuucuugggucucuagauuuuaucaauuaaagccugugggaacagccggaccggcuagagguaggcuuuaa

SEQ ID NO: 6982 - RNA, 1623 nt, Artificial Sequence
  VP1__Norovirus_and/or_Norovirus-like__LN854563
augaugauggcgucuaaggacgcuacaccaagcgcagauggcgccacuggcgccggccagcugguaccggagguuaauacagcugacccuauacccauugacccuguggcuggcuccucuacagcccuugccacugcgggucaaguuaauuugauugaucccuggauaaucaauaauuuugugcaagccccucagggcgaguucacaauauccccaaauaauacccccggugaugugcuauuugauuugcaguuagggccucaucugaauccuuuucuuucccaucuuucucagauguacaauggcugggugggcaacaugcgaguacguguuguuuuggcugguaaugcuuuuacggcugggaagguuauaauuuguuguguucccccuggcuuucaaucucgcacccuuuccauagcucaggcuacucuauuuccccauguuauugcugauguuaggacucuugauccuguagaagugccccuugaagauguuaggaauguguuguaucauaauaaugauacccaaccuaccaugcgccuccuuugcauguuguacaccccucuucgaacugggggggcgucuggugggacugauucuuuugugguggcugggcgugugcuuacuugcccaggcccugacuuuaacuucuuauuccuaguuccuccuacagucgagcaaaagacucgcccuuuuacugugccuaauauuccuuugaaguaucugucuaauucuaggaucccaaacccuauugaggguaugucuuugucaccugaccagacccaaaauguucaauuccagaaugguagguguacaauugacggucagccccucgggaccacaccugucucaguuagccaguuauguaaguuuagggguaggauuacaucuggacagagggugcucaaucugacagaguuagacgguucaccuuuuauggccuuugccgcccccgcccccgcgggcuuuccagaucucgggucuugugauuggcauauugaaaugaguaaaauuccaaacuccagcacccagaauaauccaauaguaguuaauucugucaaacccaauagucaacaguuugucccgcauuugucaaguaucacccuugaugauauuguuucuagugggggugacuauauuggcacuauacaauggaccucuccuccuucugauuccggcggagccaacacaaauuuuuggaagauuccugacuaugggucuagccuaucagaagccucacagcuggcccccgcugucuauccaccuggcuucaaugaggugauuguguacuuuauggcaucuauaccuggucccaaucaaucugguucccccaauuuggugccaugccuucucccccaggaauauauaacacauuuuaucagugagcaggcccccauucagggugaggcugccuuacuccauuauguagacccagacaccaaucguaauuugggugaguucaaguuguauccuggugguuaucugacuuguguuccuaauaguucuaguacuggaccucaacagcuuccucuugaugguguguuugucuuugcuucuuggguuucuagauuuuaucaauuaaagccugugggaacagccggaccggcuagagguaggcuuuaa

SEQ ID NO: 6983 - RNA, 1623 nt, Artificial Sequence
  VP1__Norovirus_and/or_Norovirus-like__AB042808
augaugauggcgucuaaggacgcuacaccaagcgcagauggcgccacuggcgccggccagcugguaccggagguuaauacagcugaccccauaccuauugacccuguggcuggcuccucuacagcccuugccacagcaggccagguuaauuugauugaucccuggauaaucaauaauuuugugcaagccccccagggcgaguucacaauauccccaaauaauacccccggugaugugcuuuuugauuugcaauuaggaccccauuuaaauccuuuccuuucccaccuuucucagauguauaaugguugggugggcaacaugcgagugcguguugucuuggcugguaaugcuuucacggcugggaagguuauaauuuguuguguccccccugguuuccaaucucgcacccuuucuauagcccaggcuacuuuauuuccccauguuauugcugauguuaggacccuugacccuguagaagugccccuugaagauguuaggaauguguuguaucauaauaaugacacccaacccaccaugcgccuccuuugcauguuguacacuccucuccgcaccgggggagcgucuggugggacugauucuuuugugguggcugggcguguacucacuuguccgggcccugacuuuaacuucuuauuccuagucccucccacagucgagcaaaagacccgcccuuuuacugugccuaauaucccuuugaaguaccugucuaauuccaggaucccaaauccuauugaagguaugucauugucaccugaccagacccaaaauguucaauuccagaaugguagguguacaauugacggucaaccccuugggaccacaccugucucaguuagucaguuauguaaguuuagggguaggauuacaucuggacagagagugcucaacuugacagaguuggaugguucaccuuuuauggccuuugccgcccccgccccugcgggcuuuccagaucuuggguccugugauuggcauauugaaaugaguaaaaucccaaauuccagcacccagaacaacccaauagugaccaauucugucaaacccaauagucaacaguuugucccacacuugucaaguaucacccuugaugaaaauguuuccaguggaggugacuauauuggcacuauacaauggaccucaccuccuucugauucuggcggggccaauacaaauuuuuggaaaaucccugacuauggguccagccuagcagaagcuucacaacuggcccccgcugucuauccaccugguuucaaugaggugauuguguauuuuauggcaucuauaccuggucccaaucagucugggucuccuaauuuagugccaugccugcucccccaggaauauauaacacacuuuauuagugagcaggcccccauccagggugaggcugccuuacuccacuauguagacccagacaccaaucgcaauuugggugaguucaaauuauauccuggugguuauuuaaccuguguuccuaauaguucuaguacuggaccucaacaacuuccucuugaugguguauuugucuuugcuucuuggguuucuagauuuuaucaauuaaagccugugggaacagccggaccggcuagagguaggcuuuaa

SEQ ID NO: 6984 - RNA, 1623 nt, Artificial Sequence
  VP1__Norovirus_and/or_Norovirus-like__EU004679
augaggaugagugauggcgcagcgccaaaagccaacggcucugaagccagcggccaggaucuuguuccuaccgccauugaacaggccguccccauucagcccguggcuggcucggcucuugccgcccccgccgccgggcaaauuaaccaaauugacccuuggaucuuccaaaauuuuguccaaugcccccuuggugaguuuuccauuucaccucgaaacaccccaggugaaauacuguuugaucuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccuggucugcaugcuguauacgccacuccgcacaaacagcccgggugaugagucuuuuguggucucuggccgucuucuuucuaagccggcagcugauuucaauuuuguauaccugaccccccccauugagaggaccaucuaccggauggucgacuugcccgugcuacagccgcggcugugcacgcacgcucguuggccagccccgaucuauggccucuugguugacccaucccucccauccaacccccaauggcagaauggaagagugcauguugauggaacccuccuuggcacaacaccugucucuggauccuggguuuccugcuuugcagcugaggccgccuacgaguuccaauccgggacuggugagguggcaaccuucacuuugaucgagcaggauggguccgcuuaugucccuggugacagagcggccccacuuggcuaccccgauuuuucugggcaacuggagaucgaggugcagacugagacgaccaagacaggugauaagcugaaggugaccaccuuugagaugauccuuggucccacuaccaacguggaccaagcgcccuaccagggcaagguguacgccagccuagcgguugcggccucccuugaccugguugauggcagaguuagggcgguuccucgcuccaucuauggcuuucaggaugugauaccugaguauaaugauggucuucuuguuccccuugcccccccaauuggccccuuucucccuggugagauucuccugagguuccggaccuacaugcgucagcuugacaccgcugaugccgcagcagaggcaauagacugugcacucccccaggaguucauuuccugguucgcguccaaugcguucaccgugcaggcugaugcccuacuccuuagguauaggaacacccugacuggacagcugcuguuugagugcaagcucuacagcgaggguuacaucgcccuguccuacucggggucggcaccccucacuuucccaacugauggcuucuuugaggucgucaguugggucccccgccuuuuucaauuggccucugugggaagcuugacaacaggccgaacacuuaaauaa

SEQ ID NO: 6985 - RNA, 1623 nt, Artificial Sequence
  VP1__Norovirus_and/or_Norovirus-like__EU004678
augaggaugagugauggcgcagcgccaaaagccaacggcucugaagccagcggccaggaucuuguuccuaccgccguugaacaggccguccccauucagcccguggcuggcucggcucuugccgcccccgccgccgggcaaauuaaccaaauugacccuuggaucuuccaaaauuuuguccaaugcccccuuggugaguuuuccauuucaccucgaaacaccccaggugaaauacuguuugaucuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccuggucugcaugcuguauacgccacuccgcacaaacagcccgggugaugagucuuuuguggucucuggccgccuucuuucuaagccggcagcugauuucaacuuuguauaccugaccccccccauugagaggaccaucuaccggauggucgacuugcccgugcuacagccgcggcugugcacgcacgcucguuggccagccccgaucuauggccucuugguugacccaucccucccauccaacccccaauggcagaauggaagagugcauguugauggaacccuccuuggcacaacaccugucucuggauccuggguuuccugcuuugcagcugaggccgccuacgaguuccaauccgggacuggugagguggcaaccuucaccuugaucgagcaggauggguccgcuuaugucccuggugacagagcggccccacuuggcuaccccgauuuuucugggcaacuggagaucgaggugcagacugagacgaccaagacaggugauaagcugaaggugaccaccuuugagaugauccuuggucccacuaccaacguggaccaagcgcccuaccagggcaggguguacgccagccuaacggcuguggccucccuugaccugguugauggcagaguuagggcgguuccucgcuccaucuauggcuuucaggaugugauaccugaguauaaugauggccuucuugucccccuugcccccccaauuggccccuuucucccuggugagguucuccugagguuccggaccuacaugcgucagcuugacaccgcugaugccgcagcagaggcaauagacugugcacucccccaggaguucauuuccugguucgcguccaacgcguucaccgugcagucugaugcccuacuccuuagguauaggaacacccugacuggacagcugcuguuugagugcaagcucuacagcgaggguuacaucgcccuguccuacucggggucgggaccccucacuuucccaacugauggcuucuucgaggucgucaguugggucccccgccuuuuucaauuggccucugugggaagcuugacaacaggccgaacacuuaaauaa

SEQ ID NO: 6986 - RNA, 1623 nt, Artificial Sequence
  VP1__Norovirus_and/or_Norovirus-like__AB281085
augaagauggcgucgaaugacgccgcuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggccccuaauggugaauuuacagucucuccccguaaugccccuggugaagugcuauugaaucuagaguuggguccagaauuaaauccuuaucuggcacauuuagcaagaauguauaacggguaugccggugggauggaggugcaggucauguuggcugggaacgcguucacagccggcaaguuggucuucgccgcugugccaccucauuucccgguugaaaaucuuaguccacagcaaaucaccauguucccucaugugauuauagauguaaggacuuuggaaccuguuuuauuaccacucccugauguuagaaauaauuucuuccauuauaaucagaaagaugaucccaagaugagaauuguggcuaugcuuuauaccccccuuaggucuaaugguucaggugaugauguguuuacagucuccugcaggguguugaccagacccuccccugauuuugauuuuacauaucuggugccaccaacaguggaaucuaaaacaaaaccauuuacccuuccaauccucacacuuggggaacuuuccaauucuagauucccaguguccauagaccagauguacaccagccccaaugaaguuauaucagugcagugucaaaaugguaggugcacacuggauggggagcuccaaggaacaacacaacuccaagucaguggcauuugugcuuucaagggagaagugaccgcccacuugcaugacaaugaucaccuauauaaugucaccaucacaaacuugaauggguccccuuuugaucccuccgaggacauccccgccccucugggcguaccugacuuucagggaagggucuuuggugucaucucccaaagagacaaacacauugccucuggacauaaugaaccagcaaacagaggacacgacgcuguggucccuacuuacacagcacaguacacuccaaaauugggucagauucaaauuggcacauggcagaccgacgaucuuacagucaaccaaccagucaaauucaccccaguuggacucaaugacacugaccauuuuaaccaaugggugguccccagauaugcuggugcucuaaaccuuaacacaaaccuugccccuucuguugcuccaguauuuccaggggagcgucugcucuuuuucagaucauacaucccccucaagggugguuauggaaauccagccauugauugccuacuaccacaagagugggugcaacauuucuaucaggaaucagccccuucaaugagugagguggcccuugucagauacauuaacccggacacuggccgggcacuguuugaggccaagcuccacagagcugguuucaugacagucucaagcaacaccagugcuccggugguugugccugccaacggauacuucagauuugauucuuggguaaaccaauucuauucucucgcccccaugggaacuggaaaugggcguagaagguaa

SEQ ID NO: 6987 - RNA, 1623 nt, Artificial Sequence
  VP1__Norovirus_and/or_Norovirus-like__AB662868
augaagauggcgucgaaugacgccgcuccaucuacugauggugcagccggccucgugccagaaaguaauaaugaggucauggcucuugaacccguggcuggugcugccuuggcagccccggucaccggucaaacaaauauuauagacccuuggauuagagcaaauuuuguccaggcccccaauggugaguuuacaguuucuccccgcaauuccccuggugaggugcuauugaaucuagaguuggguccagaauuaaauccuuaucuggcacauuuagcaagaauguacaacggguaugccggugggauggaggugcaggucauguuggcugggaacgcguucacagccggcaaguuggucuucgccgcuguaccaccucacuucccgguugaaaaccuuagcccacagcaaauuaccauguucccucaugugauuauagauguuaggacuuuggaaccuguuuuguuaccacucccugauguuagaaauaauuucuuccauuacaaucagaaagaugaucccaagaugagaauuguggcuaugcuuuacaccccccuuaggucuaaugguucaggugacgauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaaguuauaucagugcagugucaaaauggcaggugcacacuggauggggaacuccaaggaacaacacaacuccaagucaguggcauuugugcuuucaagggagaagugaccgcccacuugcaugacaaugaacaccuguauaaugucaccaucauaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacacuccaaaauugggucagauucaaauuggcacauggcagaccgacgaucucacaaacaaccaaccagucaaauucaccccaguuggacuuaaugauacugaacauuuugaccaaugggugguccccagauaugcuggugcccuaaaccuuaacacaaaccuugccccuucuguugcuccaguauuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugacucuugggugaaccaauucuauucucucgcccccaugggaacuggaaaugggcguagaagguaa

SEQ ID NO: 6988 - RNA, 1623 nt, Artificial Sequence
  VP1__Norovirus_and/or_Norovirus-like__AB662861
augaagauggcgucgaaugacgccguuccaucuacugauggugcagccggccucgugccagaaaguaauaaugaggucauggcucuugaacccguggcuggugccgccuuggcagccccggucaccggucaaacaaauauuauagacccuuggauuagagcaaauuuuguccaggcccccaauggugaguuuacaguuucuccccgcaauuccccuggugaggugcuauugaaucuagaguuggguccagaauuaaauccuuaucuggcacauuuagcaagaauguacaacggguaugccggugggauggaggugcaggucauguuggcugggaacgcguucacagccggcaaauuggucuuugccgcugugccaccucacuucccgguugaaaaccuuagcccacagcaaauuaccauguucccucaugugauuauagauguuaggacuuuggaaccuguuuuauuaccacucccugauguuagaaauaauuucuuccauuacaaucagaaagaugaucccaagaugagaauuguggcuaugcuuuacaccccccuuaggucuaaugguucaggugaugauguguuuacagucucaugcaggguguugacuagacccuccccugauuuugauuucacauaccuggugccaccaacaguggaaucuaaaacaaaaccauuuacucucccaauccucacgcuuggggaacuuuccaauucuagauucccaguguccauagaccagauguacaccagccccaaugaaguuauaucaguacagugucaaaacggcaggugcacacuggauggggaacuccaaggaacaacacaacuccaagucaguggcauuugugcuuucaagggggaagugacugcccacuugcaugacaaugaacaccuguacaaugucaccaucacaaacuugaaugggucuccuuucgaccccuccgaggacauccccgccccucugggcguaccugacuuucagggaagggucuuugguguuaucucccaaagagacaaacacaauaccccuggacauaaugaaccagcaaacagggcacacgaugccgugguaccuacuuacacagcacaguacacuccaaaauugggucagguccaaauuggcacauggcaaaccgacgaucucacagacaaccaaccagucaaauucaccccaguuggacuuaaugauacugaacauuuuaaccaaugggugguccccagauaugcuggugcccuaaaccuuaacacaaaccuugccccuucuguugcuccaguauuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccagauacuggucgggcacuguuugaggccaaacuccacagagcugguuucaugacagucucaagcaacaccagugccccggugguugugccugccaacggauacuucagauuugacucuugggugaaccaauucuauucucuugcccccaugggaacuggaaaugggcguagaagguaa

SEQ ID NO: 6989 - RNA, 1623 nt, Artificial Sequence
  VP1__Norovirus_and/or_Norovirus-like__LC145791
augaagauggcgucgaaugacgucgccccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuagaaacaacuucuuccauuacaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagguucccaguguccauagaucagauguacaccagccccaaugaagucauaucaguacagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugguccccagguaugcuggugcccuaaaccuuaacacaaaccuugccccuucuguugcuccaguauuuccaggggagcgucugcucuuuuucagaucauacaucccccucaaggguggcuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaagguaa

SEQ ID NO: 6990 - RNA, 1623 nt, Artificial Sequence
  VP1__Norovirus_and/or_Norovirus-like__LC145790
augaagauggcgucgaaugacgccgcuccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuagaaauaacuucuuccauuacaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucaguacagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugguccccagguaugcuggugcccuaaaccuuaacacaaaccuugccccuucuguugcuccaguauuuccaggggagcgucugcucuuuuucagaucauacaucccccucaaggguggcuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaagguaa

SEQ ID NO: 6991 - RNA, 1623 nt, Artificial Sequence
  VP1__Norovirus_and/or_Norovirus-like__LC145793
augaagauggcgucgaaugacgccgcuccaucuacugauggugcagccggccucgugccagaaaguaauaaugaggucauggcucuugaacccguggcuggugucgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuagaaacaacuucuuccauuacaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagguucccaguguccauagaucagauguacaccagccccaaugaagucauaucaguacagugucaaaauggcaggugcacacuggauggggaacuccaaggaacaacacaacuccaagucaguggcauuugugcuuucgagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaucaaugggugguccccagguaugcuggugcccuaaaccuuaacacaaaccuugccccuucuguugcuccaguauuuccaggggagcgucugcucuuuuucagaucauacaucccccucaaggguggcuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaagguaa

SEQ ID NO: 6992 - RNA, 1623 nt, Artificial Sequence
  VP1__Norovirus_and/or_Norovirus-like__LC145792
augaagauggcgucgaaugacgccgcuccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuagaaauaacuucuuccauuacaaucagaaagaugaucccaagaugagaauuguggcuaugcuuuauaccccccuuaggucuaaugguucaggcgaugauguguuuacagucuccugcagggugcugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucaguacagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugcuccccagguaugcuggugcccuaaaccuuaacacaaaccuugccccuucuguugcuccaguauuuccaggggagcgucugcucuuuuucagaucauacaucccccucaaggguggcuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcgcagaagguaa

SEQ ID NO: 6993 - RNA, 1623 nt, Artificial Sequence
  VP1__Norovirus_and/or_Norovirus-like__LC145797
augaagauggcgucgaaugacgccgcuccaucuacugauggugcagccggccucgugccagaaaguaauaaugaggucauggcucuugaacccguggcuggugucgccuuggcagccccagucaccggucaaacaaauauaauagacccuuggauuagagcaaauuuugucccggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuagaaacaacuucuuccauuacaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaauuauucacucucccaauccucacgcuuggggaacuuuccaauucuagguucccaguguccauagaucagauguacaccagccccaaugaagucauaucaguacagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaucucuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugguccccagguaugcuggugcccuaaaccuuaacacaaaccuugccccuucuguugcuccaguauuuccaggggagcgucugcucuuuuucagaucauacaucccccucaaggguggcuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaagguaa

SEQ ID NO: 6994 - RNA, 1623 nt, Artificial Sequence
  VP1__Norovirus_and/or_Norovirus-like__LC145808
augaagauggcgucgaaugacgccgcuccaucuacugauggugcagccggccucgugccagaaaguaauaaugaggucauggcucuugaacccguggcuggugccgccuuggcagccccagucacuggucaaacaaauauaauagacccuuggauuagagcaaauuuuguccaggcccccaauggugaauuuacagucucuccccguaacuccccuggugaagugcuacugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuuuccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuccagggaagggucuuuggugucaucucccaaagagacaaacauaacgccccuggacauaaugaaccagcaaacagggcacacgaugccguggucccuacuuauacagcacaguauaccccaaaauugggucagauccaaauuggcacauggcagacugacgaucucacagucaaccaaccagucaaauucaccccaguuggacuuaaugacacugaccauuuuaaccaaugggugguccccagguaugcuggugcccuaaaccuuaacacaaaccuugccccuucuguugcuccaguauuuccaggggagcgucugcucuuuuucagaucauacaucccccucaagggcgguuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauauuucagguuugauucuugggugaaccaauucuauucucucgcccccaugggaacuggaaaugggcgcagaagguaa

SEQ ID NO: 6995 - RNA, 1623 nt, Artificial Sequence
  VP1__Norovirus_and/or_Norovirus-like__LC145801
augaagauggcgucgaaugacgccgcuccaucuacugauggugcagccggccucgugccagaaaguacuaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaaugcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuacaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcgcaccugacuuucagggaagggucuuuggugucaucucccaaagagacaaacacaacaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugguccccagguaugcuggugcccuaaaccuuaacacaaaccuugccccuucuguugcuccaguauuuccaggggagcgucugcucuuuuucagaucauacaucccccucaagggcgguuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaagguaa

SEQ ID NO: 6996 - RNA, 1623 nt, Artificial Sequence
  VP1__Norovirus_and/or_Norovirus-like__AB662884
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuacuaccacucccugauguuaggaauaacuucuuccauuacaaucagaaagaugaucccaagaugagaauuguggcuaugcuuuacaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccaguuggacuuagugauacugaccauuuuaaccaaugggugguccccagguaugcuggugcccuaaaccuuaacacaaaccuugccccuucuguugcuccaguauuuccaggggagcgccugcucuuuuucagaucauacaucccccucaagggugguuauggaacuccagccauugauugccuacugccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaagguaa

SEQ ID NO: 6997 - RNA, 1623 nt, Artificial Sequence
  VP1__Norovirus_and/or_Norovirus-like__LC145802
augaagauggcgucgaaugacgccgcuccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuguugaaucuagaguuggguccagaauuaaauccuuaucuggcacauuuagcaagaauguauaaugggcaugccggugggauggaggugcaggucauguuggcugggaaugcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuacaccccccuuaggucuaaugguucaggcgaugauguguuuacagucuccugcaggguguugacuagacccuccccugauuuugaauucacauaucuggugccaccaacaguggaaucuaaaacaaaaccauucacucucccaauccucacgcuuggggaacuuuccaauucuagauucccaguguccauagaccagauguacaccagccccaaugaagucauaucagugcagugucaaaauggcagguguacacuggauggggaacuccaaggaacaacacaacuccaagccaguggcauuugugcuuucaagggagaagugacugcccacuugcaugauaaugaucaccuguauaaugucaccaucacaaacuugaauggguccccuuuugaccccuccgaggacauccccgccccucugggcguaccugacuuucagggaagggucuuuggugucaucucccaaagagacaaacacaacgccccuggacauaaugaaccagcaaacagggcacacgaugccguggucccuacuuauacagcacaguauaccccaaaauugggucagauucaaauuggcacauggcagacugacgaucuuacagucaaccaaccagucaaauucaccccaguuggacuuaaugacacugaccauuuugaccaaugggugguccccagguaugcuggugcccuaaaccuuaacacaaaccuugccccuucuguugcuccaguauuuccaggggagcgucugcucuuuuucagaucauacaucccccucaagggcgguuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagaagguaa

SEQ ID NO: 6998 - RNA, 1623 nt, Artificial Sequence
  VP1__Norovirus_and/or_Norovirus-like__AB662897
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagauguuaggacuuuggaaccuguuuuacuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaagggacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaacgaaccagcaaacagggcacacgaugccguggucccuacuuacacagcacaguacaccccaaaauugggucagauucaaauuggcacauggcagacugacgaucucacagucaaccaaccagucaaauucaccccaguuggacuuaaugauacugaccauuuuaaccaaugggugguccccagguaugcuggugcccuaaaccuuaacacaaaucuugccccuucuguugcuccaguauuuccaggggagcgccugcucuuuuucagaucauacaucccccucaagggugguuauggaacuucagccauugauugccuacugccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuacucucucgcccccaugggaacuggaaaugggcguagaagguaa

SEQ ID NO: 6999 - RNA, 1623 nt, Artificial Sequence
  VP1__Norovirus_and/or_Norovirus-like__AB662899
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuauuaccacucccugauguuaggaauaacuuuuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucuuccaauccuuacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccucugaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccaguuggacuuaaugauacugaccauuuuaaccaaugggugguccccagguaugcuggugcccuaaaccuuaacacaaaccuugccccuucuguugcuccaguauuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccggauacuggucgggcacuguuugaggccaaacuccacagagcuggcuucaugacagucucaagcaacaccagugccccggugguugugccugccaacggauacuucagauuugauucuugggugaaccaauucuauucucucgcccccaugggaacuggaaaugggcguagaagguaa

SEQ ID NO: 7000 - RNA, 1623 nt, Artificial Sequence
  VP1__Norovirus_and/or_Norovirus-like__AB662894
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugaugaucucacagucaaccaaccagccaauuucaccccaguuggacuuagugauacugaccauuuuaaccaaugggugguccccagguaugcuggugcccuaaaccuuaacacaaaccuugccccuucuguugcuccaguuuuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaagguaa

SEQ ID NO: 7001 - RNA, 1623 nt, Artificial Sequence
  VP1__Norovirus_and/or_Norovirus-like__LC145803
augaagauggcgucgaaugacgccgcuccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguauaacggguaugccggugggauggaggugcaggucauguuggcugggaaugcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaccccaagaugagaauuguggcuaugcuuuacaccccccucaggucuaaugguucaggcgaugauguguuuacaguuuccugcaggguguugacuagacccuccccugauuuugauuucacauaucuggugccaccaacaguggaaucuaaaacaaaaccauucacucucccaauccucacgcuuggggaacuuucuaauucuagauucccaguguccauagaccagauguacaccagccccaaugaagucauaucagugcagugccaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccucuuuugaccccucugaggacauccccgccccucugggcauaccugacuuucaggggagggucuuuggugucaucucccaaagagacaaacacaacaccccuggacacaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugauacugaccauuuuaaccaaugggugguccccagguaugcuggugcccuaaaccuaaacacaaaccuugccccuucuguugcuccaguauuuccaggggagcgucugcucuuuuucagaucauacauuccccucaagggcgguuauggaacuccagccaucgauugccuacuaccacaagagugggugcaacauuucuaucaggaagcagccccuucgaugagugagguggcccuugucagauacaucaacccggauacuggucgggcacuguucgaggccaaacuccacagagcugguuucaugacagucucaagcaacaccagugccccggugguugugccugccaacggauacuucagguuugauucuugggugaaccaauucuauucucucgcccccaugggaacuggaaaugggcguagaagguaa

SEQ ID NO: 7002 - RNA, 1623 nt, Artificial Sequence
  VP1__Norovirus_and/or_Norovirus-like__AB662889
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuauuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaucauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccagguuaguggcauuugugcuuucaagggagaagugacugcccacuugcaugauaaugaucaccuguauaaugucaccaucacaaacuuaaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugaugaucucacagucaaccaaccagucaauuucaccccaguuggacuuagugauacugaccauuuuaaccaaugggugguccccagguaugcuggugcccuaaaccuuaacacaaaccuugccccuucuguugcuccaguuuuuccaggggagcgccugcucuuuuucagaucauacaucccccucaagggugguuauggaacuccagccauugauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaagguaa

SEQ ID NO: 7003 - RNA, 1623 nt, Artificial Sequence
  VP1__Norovirus_and/or_Norovirus-like__AB662876
augaagauggcgucgaaugacgccgcuccaucuacugauggugcagccggccucgugccagagaguaauaaugaggucauggcucuugaacccguggcuggugccgccuuggcagccccagucaccggucaaacaaauauuauagacccuuggauuagagcaaauuuuguccaggcccccaauggugaauuuacagucucuccccguaacuccccuggugaagugcuauugaaucuagaguuggguccagaacuaaauccuuaucuggcacauuuagcaagaauguacaauggguaugccggugggauggaggugcaggucauguuggcugggaacgcguucacagccggcaaguuagucuucgccgcugugccaccucacuucccggucgaaaaccuuagcccacagcaaauuaccauguucccucaugugauuauagaugucaggacuuuggaaccuguuuuacuaccacucccugauguuaggaauaacuucuuccauuacaaucagaaagaugaucccaagaugagaauuguggcuaugcuuuauaccccccuuaggucuaaugguucaggugaugauguguuuacagucuccugcaggguguugacuagacccuccccugauuuugauuucacauaucuggugccuccaacaguggaaucuaaaacaaaaccauucacucucccaauccucacucuuggggaacuuuccaauuccagauucccaguguccauagaccagauguacaccagccccaaugaagucauaucagugcagugucaaaauggcaggugcacacuggauggggaacuucaaggaacaacacaacuccaggucaguggcauuugugcuuucaagggagaagugacugcccacuugcaugauaaugaucaccuguauaaugucaccaucacaaacuuaaauggguccccuuuugaccccuccgaggacauucccgccccucugggcguaccugacuuucagggaagggucuuuggugucaucucccaaagagacaaacacaauaccccuggacauaaugaaccagcaaacagggcacacgaugccguggucccuacuuacacagcacaguacaccccaaaauugggucagauucaaauuggcacauggcagacugacgaucucacagucaaccaaccagucaauuucaccccagcuggacuuagugauacugaccauuuuaaccaaugggugguccccagguaugcuggugcccuaaaccuuaacacaaaccuugccccuucuguugcuccaguauuuccaggggagcgccugcucuuuuucagaucauacaucccccucaagggugguuauggaacuccagccauugauugccuacugccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagauuugauucuugggugaaccaauucuauucucucgcccccaugggaacuggaaaugggcguagaagguaa

SEQ ID NO: 7004 - RNA, 1620 nt, Artificial Sequence
  VP1__Norovirus_and/or_Norovirus-like__KU555841
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccuauucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauugguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccuuaaugguacaacauaugacccaacugaugaugugccagccccgcuggguacaccugacuucaagggcgucguguuugggaugguaagccaaagaaauguggguagugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcccacucuggagacuauccucuuguuguuccggcuaauggacacuuuagauuugauucuuggguaaaucaguuuuacucacucgccccaaugggaacugggaaugggcguaggagggcucaguaa

SEQ ID NO: 7005 - RNA, 1620 nt, Artificial Sequence
  VP1__Norovirus_and/or_Norovirus-like__GQ856468
augaagauggcgucgaaugacgccgcuccaucuaacgauggugcuacaggucucguaccagagaucaacacugagaccuugccucucgagcccguggccggagcggcaauugcugccccuguuacgggccaaaauaauauaauugaucccuggauuagaaauaauuuugugcaggcgccuaauggugaguuuacagucuccccuagaaauuccccuggugaaauuuuaaugaacuuggaguuagggccagaucuuaauccauauuuggcucaccuuucaagaauguacaaugguuaugcuggagguguagaagugcaagugcuccuagcugggaaugcguucacggcaggaaagauccuuuuugcagcaguccccccaaauuuccccguugauaugcucaguccugcucaaaucacaaugcuuccccauuuaauuguagaugucagaacuuuggagcccauuaugaucccucugcccgauguuaggaauguuuucuaucacuuuaauaaccagccugccccaagaaugagauugguugccaugcucuacaccccuuuaagauccaauggguccggugaugacguauucaccgucuccugcaggguguuaaccagaccuacuccggacuuugaguuuacauacuuagucccccccucgguagaguccaaaaccaaaccuuucacccuacccauccuaacaauuggagaguugacaaacucuagauuuccagccccgaucgaucaguuguacacuucacccaacgcugauauaguuguccaaccccaaaauggccggugcacacuggauggugagcuacaagguacaacacaacuuuugacaacagcaauaugcucauacaggggcaugacaucaaaccccacuagugacuacugggaugaucaccuccugcaccugguccaccccaauggggcaacauaugacccgaccgaggacgugccagcuccuuuuggcacgcaggacuuucggggcauuuuguaugggauguugacucaaaacccccgaaccuccggggacgaagccgccaacucccaugggaucuacaucucauccaccagugaaaaguucacuccaaaauuggguacaauuggcuuacaccaagugcaagggcgacauagccagcaccaacagucaaaauucacaccaguagggauagcagugaauggcaacacuccuuucagacagugggaacucccaaacuacucuggugcccucacccucaacacaaaccuugcaccagcgguugggcccaacuucccuggggagcaaauccuuuucuucaggucaaauguuccaaguguucaagguggccaaccuauagagauugauugccugaucccacaagaaugggucucccauuuuuaucaagaaucagccccuucucagagugauguggccuuggucagguaugucaacccugacacagggcgcacaaucuuugaggccaaauugcauaggcagggauuuaucaccauagcggccacuggaagcaaccccguggucgugccucccaauggguauuucagauuugauuccugggucaaccaguuuuaugcacucgcccccaugggaacugggaaugggcgcagaagaguucaguaa

SEQ ID NO: 7006 - RNA, 1620 nt, Artificial Sequence
  VP1__Norovirus_and/or_Norovirus-like__AB684681
augaagauggcgucgaaugacgccgcuccaucuaaugauggugcugcuggucucguaccagagggcaauaacgagacccuacccuuagaaccaguugcgggcgcagcuauugccgcacccgucacuggucaaaacaauauaauugaccccuggauuagaacaaauuuuguacaagcaccaaauggagaguuuacaguaucaccuagaaacuccccuggagaaauuuuacuaaauuuagaauuaggcccugauuugaauccuuauuuggcccauuuaucaagaauguauaaugguuaugcuggugguguggagguacagguccucuuggcagggaacgcguucacugccggaaagauucuguucgcugcugucccaccaaauuucccaguagaauucuuaaguccagcucaaaucacaaugcuuccacauuuaauaguagauguuaggacccuugaaccaauuaugaucccucucccugauguuaggaauacauucuuccauuacaacaaucagccugccaaucgcaugagguugguggcuaugcuuuacaccccccuuaggucuaacggaucaggugaugaugucuucacuguuucuuguaggguauugacuaggcccacuccugauuuugaguuuacuuauuuagugcccccuucuguggagucuaagacuaaaccuuuuucuuuacccaucuuaacccuuucugaacuaacaaauucaagguucccagcccccauugauucacuuuucaccgcucaaaauaaugugcuacaggugcagugucagaaugguaggugcacacuugauggugagcugcaggguacaacccaacugcuucccacuggaauuugugcauucagaggacgggugacagcagagaccgacaacccugacaaguggcacaugcaacugcaaaaccucaauggcacaacauaugauccaacugaugaugugccggccccauuaggcacaccugacuucagaggccuucucuuuggagucgcaagucaaagaaaugugggcaaugacgcaccuggcucaaccagggcacaugagguggugauuucaacuacuaguccccaauuuguccccaaauuggguucuaucaacuuuagaagcaccagugaagacuuccgcacuggucagccaacaagauucacaccaguaggcauuaaugaugaagacaaccacccguucaaccaaugggaacugccagacuauucagggcggcucaccuugaacaugaaccucgccccuccagucgcuccaaacuucccuggugaacaauugcuauucuuuagauccaaugucccaugcucaggaggcuacaaccaaggcaucauagauugucuuaucccucaagaauggauucaacauuucuaucaagaaucagcccccucccagucagaaguggcccuaaucagguaugucaacccugacacggggcgcacccuguuugaggcaaaauugcauaggacuggauacauuacuguugcucauucuggagauuauccucuuguuguuccggcuaauggauacuuuagauuugauuccuggguaaaccaguuuuacucacucgccccaaugggaacugggaaugggcgcagaagagcucaauaa

SEQ ID NO: 7007 - RNA, 1620 nt, Artificial Sequence
  VP1__Norovirus_and/or_Norovirus-like__AB809988
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauacugaccauuuccgaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaggagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacuagcccccaugggaacuggcaaugggcguagauaa

SEQ ID NO: 7008 - RNA, 1620 nt, Artificial Sequence
  VP1__Norovirus_and/or_Norovirus-like__AB810011
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcucccccauuugaucguagauguuaggacauuggaaccuauuaugauacccuuaccugauguuaggaauguguucuaucauuuuaauaaucaaccccaaccuaggaugagauuaguggccaugcucuauaccccauugagaucuaaugguucaggagaugaugucuuuacugugucuuguagaguguugacuaggccaaccccugacuuugaauucauuuaccuaguuccucccucuguagaguccaaaacuaaaccauucacacuuccaauauugaccauuucugaacuaaccaacucccgguuccccaucccaauugagcaacuguacacggccccaaaugagaauaauguuguacagugucaaaauggaaggugcaccuuggauggagagcuucagggcaccacccagcuacuaucaagugcagucugcucuuacaggggcaggacuguggcuaacagaggggacaauugggaccagaauuugcuccagcugaccuacccaaguggugcaagcuaugaccccacugaugaagugccagcaccuuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggaguugcucagaaugaaaacacccccuuccagcaauggguucuaccacacuacgcaggugcucucgcucuaaacaccaauuuggcacccgcuguugccccgacuuucccuggcgagcaauuacuguucuucaggucucguguuccauguguucaaggccugcgcgggcaggaugcuuucauagauugucuccuaccucaagagugggugaaucauuuuuaucaagaggcugcucccucccaagcagacguugcccucaucagguaugucaacccugauacuggucgcacgcuguuugaggccaaauugcauaggucagguuuuauuacuguaucacacacuggugccuacccucuugugguccccccaaauggucauuucagguuugauucuuggguuaaucaauucuacucacucgcccccaugggaacuggcaaugggcguagauaa

SEQ ID NO: 7009 - RNA, 1620 nt, Artificial Sequence
  VP1__Norovirus_and/or_Norovirus-like__AB809994
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguaugggguguuaacccaagacaauguaagugaggguacaggggaggccaaaaacgcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaauaccaauuuggcacccgcuguugccccgacuuucccuggcgagcaauuacuguucuucaggucccguguuccauguguucaaggccugcagaggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgcccccaugggaacuggcaaugggcguagguaa

SEQ ID NO: 7010 - RNA, 1620 nt, Artificial Sequence
  VP1__Norovirus_and/or_Norovirus-like__KX767083
augaagauggcgucgagugacgccaacccaucugauggguccgcagccaaccucgucccagaggucaacaaugagguuauggcucuggagcccguuguuggugccgcuauugcggcgccuguagcgggccaacaaaauguaauugaccccuggauuagaaauaacuuuguacaagccccugguggagaguuuacaguguccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagaaccuguguugauucccuuacccgaugucaggaauaauuucuaccauuacaaccaaucaaaugaccccacuauuaaguugauagcaauguuguauacaccacuuagggcuaauaaugcuggggacgaugucuucacaguuucuugccgaguucucacgagaccaucccccgauuuugacuuuauauuuuuaguaccacccacaguugagucaagaaccaaaccauucucuaucccaguuuuaacaguugaggagaugaccaauucaagauuccccauuccuuuggagaaguuguucacgggucccagcagcgccuuuguuguucaaccacaaaacggcaggugcacgacugauggcgugcuccuaggcaccacccaacuguccccugucaacaucugcaccuucagaggggaugucacccauaucacaggcagucacaacuacacaaugaauuuggcuucucaaaauuggaacaguuaugacccaacagaagaaaucccagccccucuaggaacuccagacuuuguggggaagauucaaggugugcucacccaaaccacaagggcagauggcucaacacgcggccacaaagcuacaguguacacugggagcgccgacuuugcuccaaaacuggguagaguucaauuuggaacugacacaagcaaugauuuugaagcuaaccaaaacacaaaguucaccccagucggugucauccaagauggugacaccacccaucgaaaugaaccccaacagugggugcucccaaguuacucaggcagaaauacucauaaugugcaucuggcccccgcuguagcccccacuuucccgggcgagcaacuucucuucuuuagauccaccaugcccggaugcagcggguaccccaacauggauuuggacugucugcucccccaggaaugggugcagcacuucuaccaagaggcggccccagcgcaaucugauguggcucugcuaagauuugugaauccagacacagguaggguuuuguuugagugcaagcuucauaaaccagguuaugucacaguggcucauacuggccaacacgauuuggucaucccccccaauggcuauuuuagguuugauucuuggguuaaccaguucuacacgcuugcccccaugggaaauggaacggggcguagacguguauaa

SEQ ID NO: 7011 - RNA, 1620 nt, Artificial Sequence
  VP1__Norovirus_and/or_Norovirus-like__LN854565
augaagauggcgucgaaugacgccaacccaucugauggguccgcagccaaccucgucccagaggucaacaaugagguuauggcuuuggagcccguugucggugccgcuauugcggcgccuguagcgggccaacaaaauauaauugaccccuggauuagaaacaauuuuguacaagccccugguggagaguucacaguauccccuagaaacgcuccaggcgaaauacuauggagcgcgcccuuaggaccugauuugaaucccuaccuaucucauuuggccagaauguauaaugguuaugcaggugguuuugaagugcaggugauccuugcggggaacgcguucaccgcuggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaccauuauaaucagucaaaugacucuacuauuaaauugauagcaauguuguauacaccacuuagggcuaacaaugcuggggaugauguuuucacagucucuugucgaguacucacgaggccauccccugauuuugauuuuauauuuuugguaccacccacaguugagucaagaacuaaaccauuuacuaucccaaucuuaacuguugaagaaaugaccaauucaagauuccccauuccuuuggaaaaguuguacacgggucccagcagugccuucguuguccaaccacaaaacggcagaugcacgacugauggcgugcucuuaggcaccacucaacugucuccugucaacaucugcaccuucagaggggaugucaccaacauucaagguucccacacuuacacaaugaauuuggcuucucuaaauuggaacaauuaugacccaacagaagaaacuccagccccucuaggaacuccagauuucgugggaaagauccaaggugugcucacucaaaccacaaagggacaaggcucgacccguggccauaaagccacaguauacacugggagugccuccuuuacuccaaagcuaggcaguguucaauuuagaacugauacacaaaaugauuuuguaacucaccaaaacacaaaauucaccccagucgguguuauccaggauggugacaccacccaccgaaaugaaccccaacaaugggugcucccaaauuauucagguguaaauacccauaaugugcaccuagccccugcuguagcucccaccaucccgggugaacaacuucucuucuucagguccaguaugcccggaugcagcggguaucccaacauggauuuggauugccuagucccccaggaaugggugcagcacuucuaccaggaggcagcuccagcacuaucugauguggcucuauugagauuugugaauccagacacugguaggguccuguuugaguguaaacuucauaaaucaggcuauguuacaguggcccacaccggccaucaugauuuggucaucccucccaauggcuauuuuagguuugauuccuggguuaaccaauuuuacacacuugcccccaugggaaauggaacggggcguagacguguuuaa

SEQ ID NO: 7012 - RNA, 1620 nt, Artificial Sequence
  VP1__Norovirus_and/or_Norovirus-like__KX354071
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccggaaaaaucauauuugcagcagucccaccaaauuuuccaaccgaaggcuugagucccagccaggucacuauguucccccacauaauaguagauguuaggcaauuggaaccuguguugauccccuuaccugauguuaggaauaauuucuaucauuauaaucagucaaaugauucuaccauuaaauugauagcaaugcuguauacaccacuuagggccaauaaugcuggggaugaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccaucccuuuggaaaaauuguucacgggucccagcagugccuuuguuguucaaccacaaaauggcagaugcacgacugauggcgugcucuuaggcaccacccaacugucuccuguuaacaucugcaccuucagaggggaugucacccacauugcagguucucgugauuacacaaugaauuuggcuucucuaaauuggaacaauuaugacccaacagaagaaauuccagccccucuaggaacuccagacuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaucaaaacacaaaauucaccccagucggugucauccagaaugguagcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguaucccaacauggauuuggauugccuacucccacaggagugggugcagcacuucuaccaagaggcagcuccagcacaaucugauguggcucuauugagauuugugaauccagacacgggcaggguucuguuugagugcaaacuucauaaaucaggcuaugucacaguggcucacaccggucagcaugauuuggucaucccccccaauggcuauuuuagguuugauuccuggguuaaucaauucuacacacuugcccccaugggaaauggaacggggcgcagacguguuuaa

SEQ ID NO: 7013 - RNA, 1620 nt, Artificial Sequence
  VP1__Norovirus_and/or_Norovirus-like__AB933688
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggccagaauguauaaugguuaugcaggugguuuugaagugcaggugauccucgcggggaacgcguucaccgccggaaaaauuauauuugcagcagucccaccaaacuucccaacugaaggccugagucccagccagguuacuauguucccccacauaauaguggauguuaggcaauuggaaccuguauugauccccuuaccugauguuaggaauaacuuuuaucauuauaaucagucaaaugauucuaccauuaaauugauagcaaugcuguauacaccacuuagggcuaauaaugcuggggaagaugucuucacaguuucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagugccuuuguuguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccuuuaggaaccccagauuucgugggaaagauccaagguaugcucacucaaaccacaaagggagauggcucgacccguggccauaaagcuacaguuuacacugggagugcccccuuuacuccaaagcugggcaguguucgguucaguacugacacagaaaaugauuuugaaauucaccaaaauacaaaauucacuccagucggugucauccaggaugguagcaccacccaccgaaaugaaccccaacaauggguacucccaaguuauucagguagagaugcccauaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguucuguuugagugcaaacuccauaaaucaggcuaugucacaguggcucacaccggccagcaugauuuggucaucccccccaaugguuauuuuagguuugauuccuggguuaaucaauucuauacacuugcccccaugggaaauggaacggggcguagacguguuuaa

SEQ ID NO: 7014 - RNA, 1620 nt, Artificial Sequence
  VP1__Norovirus_and/or_Norovirus-like__GQ845337
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagucaggucacuauguucccccacauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcaggcucucguaauuacacaaugaauuuggcuucccuaaauuggaacaauuaugacccaacagaagaaauuccagccccccuaggaacuccagauuucgugggaaagauccaaggugugcucacucaaaccacaaagggagauggcucgacccguggccauaaagcuacagucuacacugggagugcccccuuuacuccaaagcugggcaguguucaauucaguacugauacagaaaaugauuuugaagcucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggauguagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucauaccggccagcaugauuuggucauccccuccaaugguuauuuuagguuugauuccuggguuaaucaauucuacacacuugcccccaugggaaaugggacggggcgcagacguguuuaa

SEQ ID NO: 7015 - RNA, 1620 nt, Artificial Sequence
  VP1__Norovirus_and/or_Norovirus-like__JX155747
augaagauggcgucgaaugacgccaacccaucugauggguccgcggccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaacuucuaucacuauaaucagucaaaugauuccaccauuaaauugauagcaaugcuguauacaccacuuagggcuaauaaugcuggggaagaugucuucacggucucuugucgaguucucacgaggccauccccugacuuugauuuuauauuuuuggugccaccuacaguugagucaagaacuaaaccauucacugucccaauccuaacuguugaagaaaugaccaauucaagguuucccauuccuuuggaaaaauuguucacuggucccagcagugccuuuguuguccaaccacaaaauggcagaugcacgacugauggcgugcucuuaggcaccacccaacugucuccugucaacaucugcaccuucaggggggaugucacccacauugcagguucucguaauuacacaaugaauuuggcuucucuaaauuggaacaauuaugacccaacagaagaaauuccagccccucuaggaacuccagauuucgugggaaagauccaaggugugcuuacccaaaccacaaagggagaugguucgacucguggccauaaagcuacaguuuacacugggagugcccccuuuacuccaaaguugggcaguguucaguucagcacugauacagaaaaugauuuugaaacccaccaaaacacaaaauucaccccagucggugucauccaggaugguggcaccacccaccgaaaugaaccccaacaaugggugcucccaagcuauucagguagaaauguccaaaauguacaccuagccccugcuguagcccccacuuuuccgggugaacaacuucuuuucuuuagguccacuaugcccggaugcagcggguaucccaacauggauuuggauugccuacucccucaggagugggugcagcacuucuaccaagaggcagccccagcacaaucugauguggcucuauugagauuugugaauccagacacggguaggguccuguuugagugcaaacuucauaaaucaggcuaugucacaguggcucacaccggccagcaugauuuggucaucccucccaaugguuauuuuagguuugauuccugggucaaucaauucuacacacuugcccccaugggaaauggaacggggcguagacguguuuaa

SEQ ID NO: 7016 - RNA, 1620 nt, Artificial Sequence
  VP1__Norovirus_and/or_Norovirus-like__JX155737
augaagauggcgucgaaugacgccaacccaucugaugggucagcagccaaccucgucccagaggucaacaaugagguuauggcuuuggaacccguugucggugccgcuauugcggcgccuguagcgggccaacaaaauguaauugaccccuggauuagaaauaauuuuguacaagccccugguggagaguucacaguauccccuagaaacgcuccgggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauucacuguuccaaucuuaacuguugaagaaaugaccaauucaagauuccccauucccuuggaaaaauuguucacgggucccagcagugccuuuguuguucaaccacaaaauggcagaugcacgacugauggcgugcucuuagguaccacccaacugucuccugucaacaucugcaccuucagaggggaugucacccacauugcagguucucgcaauuacacaaugaauuuggcuucucuaaauuggaacaauuaugacccaacagaagaaauuccagccccucuaggaacuccagacuucgugggaaagauccaaggugugcucacucaaaccacaaagggagauggcucgacccguggccauaaagcuacaguuuacacugggagugccccauuuacuccaaagcugggcaguguucaauucaguacugauacagaaaaugauuuugaaacucaccaaaacacaaaauucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaccaauucuacacacuugcccccaugggaaauggaacggggcguagacguguuuaa

SEQ ID NO: 7017 - RNA, 1620 nt, Artificial Sequence
  VP1__Norovirus_and/or_Norovirus-like__KX354055
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucaccauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccugggcaccacccaacugucuccugucaacaucugcaccuucagaggagaugucacccauaucacugguagucauaacuacacaaugaauuuggcuucucaaaauuggaacaauuaugacccaacagaagaaaucccagccccucuaggaacuccagauuuuguggggaagauucaaggcgugcucacccaaaccacaagggcagauggcucaacacgcggccacaaagcuacaguguacacugggagcgccgacuuugcuccaaaacuggguagaguucaauuugaaacugacacaaaccaugauuuugaggcuaaccaaaacacaaaguucaccccagucggcgucauccaagaugguggcaccacccaccgaaacgaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcagcacuucuaccaagaggcagccccagcacagucugauguggcucugcuaagauuugugaacccagacacagguaggguuuuguuugaguguaagcuucacaaaucaggcuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7018 - RNA, 1620 nt, Artificial Sequence
  VP1__Norovirus_and/or_Norovirus-like__KX353957
augaagauggcgucgaaugacgccaacccaucugauggguccgcagccaaccuugucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuaucccauuuggccagaauguauaaugguuaugcaggugguuuugaagugcaggugauucucgcggggaacgcguucaccgccggaaaaaucauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggccaauaaugcuggggaagaugucuuuacagucucuugucgaguucucacgaggccauccccugauuuugauuuuauauuuuuggugccacccacaguugagucaagaacuaaaccauuuacugucccaaucuuaacuguugaagaaaugaccaauucaagauuccccaucccuuuggaaaaauuguucacgggucccagcagugccuuuguuguucaaccacaaaauggcagaugcacgacugauggcgugcucuuaggcaccacccaacugucuccuguuaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaaggugugcucacucaaaccacaaagggagauggcucgacccguggccauaaagcuacaguuuucacugggagugcccccuuuacuccaaagcugggcaguguucaauucaguacugauacagaaaaugauuuugaaacucaucaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguaccccaacauggauuuggauugccuacucccacaggagugggugcagcacuucuaccaagaggcagcuccagcacaaucugauguggcucuauugagauuugugaauccagacacagguagaguucuguuugagugcaagcuucauaaaucaggcuaugucacaguggcucauaccggucagcaugauuuggucauccccccuaauggcuauuuuagguuugauuccuggguuaaucaauucuacacacuugcccccaugggaaauggaacggggcguagacguguuuaa

SEQ ID NO: 7019 - RNA, 1620 nt, Artificial Sequence
  VP1__Norovirus_and/or_Norovirus-like__KF509947
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucugaaucccuaccuaucccauuuggccagaauguacaaugguuaugcaggugguuuugaagugcagguaauucucgcggggaacgcguucaccgccgggaagaucauauuugcagcagucccaccaaauuucccaacugaaggcuugagccccagccaggucacuauguucccccauauaauaguagauguuaggcaauuagaaccuguguugauucccuuacccgauguuaggaauaauuucuaucauuauaaucaaucaaaugaccccaccauuaaauugauagcaauguuguauacaccacuuagggcuaauaaugcuggggacgaugucuucacaguuucuugccgaguucucacgagaccaucccccgauuuugauuucauauuucuagugccaccuacaguugagucaagaaccaaaccauucucugucccaauuuuaacuguugaggagaugaccaauucaagauuccccauucccuuggagaaguuguucacgggucccagcagugcuuuuguuguucaaccacaaaauggcaggugcacgacugauggcgugcuccuaggcaccacccaacuaucuccugucaacaucugcaccuucagaggggauaucacccauaucacagguagccgcaacuacacaaugaauuuggcuucucaaaauuggaacaauuaugacccaacagaagaaauuccagccccucuaggaacuccagauuuuguggggaagauucaaggugugcucacccaaaccacaagggcagauggcucgacacgcggccacaaagcuauaguguacacugggagcgccgacuuugcuccaaaauuggguagaguucaauuugagacugacacagaccaugauuuugaagcuaaccaaaacacaaaguucaccccagucggugucacccaagaugguagcaccacccaccgaaaugaaccccaacagugggugcucccaaguuauucaggcagaaauacucacaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucauaaaucaggcuauguuacaguggcucacacuggccaacaugauuugguuaucccccccaaugguuauuuuagauuugauuccugggucaaccaguucuacacgcuugcccccaugggaaauggaacggggcgcagacguguauaa

SEQ ID NO: 7020 - RNA, 1620 nt, Artificial Sequence
  VP1__Norovirus_and/or_Norovirus-like__AB504326
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauucccuuggaaaaauuguucacgggucccagcagugccuuuguuguucaaccacaaaauggcagaugcacgacugauggcgugcucuugggcaccacccaacugucuccugucaacaucugcaccuucagaggggaugucacccacauugcagguucucguaauuacauaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaagauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguguuuaa

SEQ ID NO: 7021 - RNA, 1620 nt, Artificial Sequence
  VP1__Norovirus_and/or_Norovirus-like__KX354056
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggagaugucacccauaucacugguagucguaacuacacaaugaauuuggcuucucaaaauuggaacaauuaugacccaacagaagaaaucccagccccucuaggaacuccagauuuuguggggaagauucaaggcgugcucacccaaaccacaagggcagauggcucaacacgcggccacaaagcuacaguguacacugggagcgccgacuuugcuccaaaacuggguagaguucaauuuggaacugacacagaccaugauuuugaggcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugacguggcucugcuaagauuugugaauccagacacagguaggguuuuguuugaguguaagcuucacaaauuaggcuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7022 - RNA, 1620 nt, Artificial Sequence
  VP1__Norovirus_and/or_Norovirus-like__AB541255
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauucccuuggaaaaauuguucacgggucccagcagugccuuuguuguucaaccacaaaauggcagaugcacgacugauggcgugcucuugggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaagauucaccccagucggugucauccaggaugguggcaccacccaccgaaaugaaccccaacagugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguguuuaa

SEQ ID NO: 7023 - RNA, 1620 nt, Artificial Sequence
  VP1__Norovirus_and/or_Norovirus-like__KP784696
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaacuuuccaacugaaggcuugagccccagccaggucacuauguucccccauauaguaguagauguuaggcaacuagaaccuguguugauucccuuaccugauguuaggaauaacuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugacuaauucaagauuccccauuccuuuggaaaagcuguucacgggucccagcagugccuuuguuguucaaccacaaaacggcaggugcacgacugauggcgugcuccuaggcaccacccaacugucuccugucaacaucugcaccuucagaggagaugucacccauaucacugguagucguaacuacacaaugaauuuggcuucucaaaauuggaauaauuaugacccaacagaagaaaucccagccccucuaggaacuccagauuuugugggggagauucaaggcguacucacccaaaccacaaggacagauggcucaacacgcggccacaaagccacaguguacacugggagcgccgacuuugcuccaaaacuggguagaauucaauuugaaacugacacagaccaugauuuugaagcuaaccaaaacacaaaguucaccccagucggugucauccaagaugguagcaccacccaccgaaaugaaccccaacaaugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguauuucuaccaagaggcagccccaucacaaucugauguggcucugcuaagauuugugaauccagacacagguaggguuuuguuugaguguaagcuucacaaaucaggcuauguuacaguggcucacacuggccaacaugauuugguuaucccccccaaugguuauuuuagguuugauuccugggucaaccaguucuacacgcuugcccccaugggaaauggaacggggcguagacgcguauaa

SEQ ID NO: 7024 - RNA, 1620 nt, Artificial Sequence
  VP1__Norovirus_and/or_Norovirus-like__KX354042
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuucccaacugaaggcuuaagccccagccaggucacuauguucccccauauaauaguagauguuaggcaacuagaaccuguguugauucccuugcccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuuuuagugccacccacaguugaaucaagaaccaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuucugucaacaucugcaccuucagaggggaugucacccauaucacagguagucguaacuacacaaugaauuuggcuucucaaaauuggaacaauuacgacccaacagaagaaaucccagccccucuaggaacuccagauuuuguggggaagauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguagcucacacuggccaacaugauuugguuauaccccccaaugguuauuuuagguuugauuccugggucaaccaguucuacacacuugcccccaugggaaacggaacggggcguagacguguauaa

SEQ ID NO: 7025 - RNA, 1620 nt, Artificial Sequence
  VP1__Norovirus_and/or_Norovirus-like__KX354007
augaagauggcgucgagugacgccaacccaucugauggguccgcagccaaccucgucccagaggucaacaaugagguuauggcucuggagcccguuguuggugccgcuaucgcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagagccuguguugauucccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuuuuggugccacccacaguugagucaagaaccaaaccauuuucugucccaguuuugacuguugaggagaugaccaauucaagauuccccauuccuuuggaaaaguuguucacaggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaagucccagccccucuaggaacuccagauuuuguggggaagauucaaggcaugcucacccaaaccacaaggacagauggcucaacacgcggccacaaagcaacaguguacacuggaagcgccgacuuuacuccaaaacuggguagaauucaauuugaaacugacacggaccaugauuuugaagcuaaccaaaacacaaaguucaccccagucggcguuauccaagaugguagcaccacccaccgaaaugaaccccaacagugggugcucccaaguuacucaggcagaaauacucauaaugugcauuuggcucccgcuguggcccccacuuuuccgggugagcagcuucucuucuucagguccaccaugcccggaugcagcggguaccccaacauggauuuggacugucugcucccucaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacacuugcccccaugggaaauggaacggggcguagacguguauaa

SEQ ID NO: 7026 - RNA, 1620 nt, Artificial Sequence
  VP1__Norovirus_and/or_Norovirus-like__KT780393
augaagauggcgucgagugacgccaacccaucugaugggucugcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccauuuggccagaauguauaaugguuaugcaggugguuuugaagugcagguaauucucgcggggaacgcguucaccgccgggaaggucauauuugcagcagucccaccaaauuuuccaacugaaggcuuaagccccagccaggucacuauguucccccacauaguaguagauguuaggcaacuagaaccuguguugauucccuuacccgauguuaggaauaauuucuaccauuacaaccaaucaaaugaccccaccauuaaguugauagcaauguuguauacaccacuuagggcuaauaaugccggggacgaugucuucacaguuucuugccgaguucucacaagaccaucccccgauuuugauuucauauuuuuagugccacccacaguugagucaagaacuaaaccauucucugucccaguuuuaacuguugaggagaugaccaauucaagauuccccauuccuuuggaaagguuguucacgggucccagcagugccuuuguuguucaaccacaaaacggcaggugcacgacugauggcgugcuccuaggcaccacccaacugacuccugucaacaucugcaccuucagaggggaugucacccauaucacaggcagucguaacuacacaaugaauuuggcuucucaaaauuggaacaauuaugacccaacagaagaaaucccagccccucuaggaacuccagacuuuguggggaagauucaaggcaugcucacccaaaccacgaggacugauggcucaacacgcggccacaaagccacaguguacacugggagcgccgacuuugcuccaaaacuggguagaguccaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcagcacuucuaccaagaggcagccccagcacaaucugauguggcucuacuaagauuugugaauccagacacagguaggguuuuguuugaguguaagcuucauaaaucaggcuauguuacaguggcucacacuggccaacaugauuugguuaucccccccaaugguuauuuuagguuugauucuugggucaaccaguucuacacgcuugcccccaugggaaauggaacggggcguagacguguauaa

SEQ ID NO: 7027 - RNA, 1620 nt, Artificial Sequence
  VP1__Norovirus_and/or_Norovirus-like__KX354043
augaagauggcgucgagugacgccaacccaucugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaaugcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagaugucagacaacuagaaccugugcugauucccuuacccgaugucaggaacaauuucuaucauuauaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuucccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaucaaaacacaaaguucaccccagucggugucauccaagaugguagcaccacccaccgaaaugagccccaacagugggugcucccaaguuacucaggcagaaacacuuauaaugugcaucuggcccccgcuguagcccccacuuuuccgggcgagcaacuucucuucuucagauccaccaugcccggaugcagcggguaccccaacauggauuuggacugucugcucccccaggaaugggugcagcacuucuaccaagaggcagccccagcacagucugauguggcucugcuaagauuugugaacccagacacagguaggguuuuguuugaguguaagcuucacaaaucaggcuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7028 - RNA, 1620 nt, Artificial Sequence
  VP1__Norovirus_and/or_Norovirus-like__KX354008
augaagauggcgucgagugacgccaacccaucugauggguccgcagccaaccucgucccagaggucaacaaugagguuauggcucuggagcccguuguuggugccgcuaucgcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagagccuguguugauucccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuuuuggugccacccacaguugagucaagaaccaaaccauuuucugucccaguuuugacuguugaggagaugaccaauucaagauuccccauuccuuuggaaaaguuguucacaggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaagucccagccccucuaggaacuccagauuuuguggggaagauucaaggcaugcucacccaaaccacaaggacagauggcucaacacgcggccacaaagcaacaguguacacuggaagcgccgacuuuacuccaaaacuggguagaauucaauuugaaacugacacggaccaugauuuugaagcuaaccaaaacacaaaguucaccccagucggcguuauccaagaugguagcaccacccaccgaaaugaaccccaacagugggugcucccaaguuacucaggcagaaauacucauaaugugcauuuggcucccgcuguggcccccacuuuuccgggugagcagcuucucuucuucagguccaccaugcccggaugcagcggguaccccaacauggauuuggacugucugcucccucaggaaugggugcaguacuucuaccaagaggcagccccagcacaaucugauguggcucugcuaagauuugugaauccagacacagguaggguuuuguuugaguguaagcuucauaaaucaggcuauguuacaguggcuuacacuggccaacaugauuugguuaucccccccaaugguuauuuuagguuugauuccugggucaaccaguucuacacacuugcccccaugggaaauggaacggggcguagacguguauaa

SEQ ID NO: 7029 - RNA, 1620 nt, Artificial Sequence
  VP1__Norovirus_and/or_Norovirus-like__KR904217
augaagauggcgucgagugacgccaacccaucugauggguccacagccaaccucgucccagaggucaacaaugagguuauggcuuuggagcccguuguuggcgccgccauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuuucagcagucccaccaaauuucccaacugaagguuugagccccagccaggucacuauguucccccacauaauaguggauguuaggcaauuagaaccuguguuaauccccuuacccgauguuaggaauaauuucuaucauuauaaucaaucaaaugaccccaccaucaaauugauagcaauguuguauacaccacuuagggcuaauaaugcuggggacgaugucuucacaguuuccugucgaguucucacgagaccaucccccgauuuugauuucauauucuuagugccacccacaguugaaucaagaaccaaaccauucucugucccaauuuuaacuguugaggagaugacuaauucaagguuccccauuccuuuggaaaaguuguucacgggccccaguagugccuuuguuguucaaccacaaaacggcaggugcucgacugauggcgugcuccuagguacuacccaacugucuccugucaacaucugcaccuuuagaggggaugucacccauauugcaggcagucauaacuacacaaugaaucuggcuucccaaaauuggagcaguuaugacccaacagaagaaaucccagccccucuaggaacuccagauuucguggggaagauucaaggugugcucacccaaaccacaaggucagaugguucgacccgcggccacaaagcuacaguguacacugggagugccgacuuuucuccaaaacuggguagaguucaauuugccacugacacagacaaugauuuuguaucuaaccaaaacacaaaguucaccccagucgguguuauccaggauggugauacugcccaccgaaaugaaccccaacaaugggugcuuccaaguuacucaggcagaaauauucauaaugugcaccuggcccccgcuguagcccccacuuuuccgggugagcaacuccucuucuuuagaucuaccauacccggaugcagcggguaccccaacauggauuuggacugccugcucccccaggaaugggugcaguauuucuaccaggaagcagccccagcacaaucugauguggcuuugcuaagauuugugaauccagauacagguaggguuuuguuugaguguaagcuucauaaaucaggcuauguuacaguggcucacacuggccaacaugauuugguuaucccccccaaugguuauuuuagauuugauuccugggucaaccauuucuacacacuugcccccaugggaaaugggacggggcgcagacgaguuuaa

SEQ ID NO: 7030 - RNA, 1620 nt, Artificial Sequence
  VP1__Norovirus_and/or_Norovirus-like__KJ685412
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggagaugucacccauaucacugguagucauaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugcaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucauacuggccaacaugauuugguuaucccccccaaugguuauuuuagguuugauuccugggucaaccaguucuacacgcuugcccccaugggaaauggaacggggcguagacguguauaa

SEQ ID NO: 7031 - RNA, 1620 nt, Artificial Sequence
  VP1__Norovirus_and/or_Norovirus-like__KF008240
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacucagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaauuggguagaguucaguuugaaacugacacagaucaugauuuugaaguuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7032 - RNA, 1620 nt, Artificial Sequence
  VP1__Norovirus_and/or_Norovirus-like__KX354125
augaagauggcgucgagugacgccaacccaucugauggguccgcagccaaccucgucccagaggccaacaaugagguuauggcucuggagcccguuguuggugccgcuauugcggcaccuguagcgggccaacaaaauguuauugaccccuggauuagaaacaauuuuguacaagccccugguggagaguuuacaguauccccuagaaacgcuccaggugaaauacuauggagcgcgcccuuaggcccugauuuaaaucccuaccuaucccauuuggccagaauguacaaugguuaugcaggugguuuugaagugcagguaauucucgcggggaacgcguucaccgccgggaaggucauauuugcagcagucccaccaaauuucccaacugaaggcuugagccccagccaggucacuauguuuccccauauaguaguagauguuaggcaacuagaaccuguguugauucccuuacccgauguuaggaauaauuuuuaucauuauaaucagucaaaugaccccacuauuaaauugauagcaauguuguauacaccacuuagggcuaauaaugcuggggacgaugucuucacagucucuugccggguccucacgagaccgucccccgacuuugauuucauauuucuagugccacccacaguugagucaagaacuaagccauucucugucccaguuuuaacuguugaggagaugaccaauucaagauuccccauuccuuuggaaaaguuguuuacgggucccagcagugccuuuguuguucaaccacaaaacggcaggugcacgacugauggcgugcuccuaggcaccacccaacugucuccugucaacaucugcaccuucagaggggacgucacccacaucacagguagucguaacuacacaaugaauuuggcuucucaaaauuggaacaauuacgacccaacagaagaaaucccagccccucugggaaccccagauuuuguagggaagauucaaggcaugcucacccaaaccacaagggcagauggcucaacacgcggccacaaagcuacaguguacacugggagcgccgauuuuucuccaaaacuggguagaguucaauuugaaacugacacagaccaugauuuugaagcuaaccaaaacacaaaguucaccccagucggugucauucaagaugguagcaccacccaccgaaaugaaccccaacagugggugcucccaaguuacucaggcagaaauacucauaaugugcaccuggcccccgcuguagcccccacuuuuccgggugagcaacuucucuucuucagguccaccaugcccggaugcagcggguauccuaacauggauuuggacugucugcucccccaggaaugggugcaguacuucuaccaagaggcagccccagcacaaucugauguggcucuguuaagauuugugaauccagacacagguagggucuuguuugaguguaagcuucauaaaucaggcuauguuacaguggcucacaccggccaacaugauuugguuaucccccccaaugguuauuuuagguuugauuccuggguuaaccaguucuauacgcuugcccccaugggaaauggaacggggcguaaacguguauaa

SEQ ID NO: 7033 - RNA, 1620 nt, Artificial Sequence
  VP1__Norovirus_and/or_Norovirus-like__KX354094
augaagauggcgucgagugacgccaacccaucugauggguccgcagccaaccucguuccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagucccagccaggucacuauguucccccauauaguaguagaugucaggcaacuagaaccuguguugauucccuuacccgauguuaggaauaacuucuaucauuacaaucaaucaaaugaccccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaagcuguuuacgggucccagcagugccuuuguuguccaaccacaaaacggcaggugcacgacugauggcgugcuccuaggcaccacucaacugucuccugucaacaucugcaccuucagaggagaugucacccauaucacagguagucguaacuacacaaugaauuuggcuucccaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaauuggguagaguucaauuugaaacugacacagaucaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggaucuggacugucugcucccccaggaaugggugcaguacuucuaccaagaggcagccccagcacaaucugauguggcucugcugagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7034 - RNA, 1620 nt, Artificial Sequence
  VP1__Norovirus_and/or_Norovirus-like__KX354058
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacgguauccccuagaaacgcuccaggugaaauauuauggagcgcgcccuuaggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagagccuguguugauucccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuuuuggugccacccacaguugagucaagaaccaaaccauucucugucccaguucuaacuguugaggagaugaccaauucaagauuccccauuccuuuggaaaaguuguucacaggucccagcagugccuuuguuguucaaccacaaaacggcaggugcacgacugauggcgugcuccuaggcaccacccaacugucuccugucaauaucugcaccuucagaggggaugucacccauaucgcagguagucguaacuacacaaugaauuuggcuucucaaaauuggaacaauuaugacccaacagaagaaaucccagccccucuaggaacuccagauuuuguggggaagauucaaggcaugcucacucaaaccacaaggacagauggcucaacacgcggccacaaagcuacaguguacacugggagcgccgaauuugcuccaaaacuggguagaguucaauuugaaacugacacagaccaugauuuugaaacuaaccaaaauacaaaguucaccccagucggcgucauccaagaugguagcaccacccaccgaaaugaaccccaacagugggugcucccaaguuacucaggcagaaauacucacaaugugcauuuggcccccgcuguagcccccacuuuuccgggugagcaacuucucuucuucagguccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7035 - RNA, 1620 nt, Artificial Sequence
  VP1__Norovirus_and/or_Norovirus-like__KX354057
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacgguauccccuagaaacgcuccaggugaaauauuauggagcgcgcccuuaggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagagccuguguugauucccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuuuuggugccacccacaguugagucaagaaccaaaccauucucugucccaguuuuaacuguugaggagaugaccaauucaagauuccccauuccuuuggaaaaguuguucacaggucccagcagugccuuuguuguucaaccacaaaacggcaggugcacgacugauggcgugcuccuaggcaccacccaacugucuccugucaauaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcaugcucacucaaaccacaaggacagauggcucaacacgcggccacaaagcuacaguguacacugggagcgccgaauuugcuccaaaacuggguagaguucaauuugaaacugacacagaccaugauuuugaaacuaaccaaaacacaaaguucaccccagucggcgucauccaagaugguagcaccacccaccgaaaugaaccccaacagugggugcucccaaguuacucaggcagaaauacucacaaugugcauuuggcccccgcuguagcccccacuuuuccgggugagcaacuucucuucuucagguccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaaugggacggggcguagacguguauaa

SEQ ID NO: 7036 - RNA, 1620 nt, Artificial Sequence
  VP1__Norovirus_and/or_Norovirus-like__KX354034
augaagauggcgucgagugacgccaacccaucugauggguccgcagccagccucgucccagaggucaacaaugagguuauggcucuggagcccguuguuggcgccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccacauaguaguagauguuaggcaacuagaaccuguguugauucccuuacccgauguuaggaauaauuuuuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucuguuccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggagaugucacucauaucacugguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggucacaaagcuacaguguacacugggagcgccgacuuugcuccaaaacuggguagaguucaauuugaaacugacacagaccaugauuuugaggcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucagguuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7037 - RNA, 1620 nt, Artificial Sequence
  VP1__Norovirus_and/or_Norovirus-like__KX354027
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccauuuggccagaauguauaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuucuagugccacccacaguugagucuagaacuaaaccauucucugucccaguuuuaacuguugaggagaugaccaauucaagauuccccauuccuuuggaaaaguuguucacgggucccagcagugccuuuguuguucaaccacaaaacgguaggugcacgacugauggcgugcuccuaggcaccacccaauugucuccugucaacaucugcaccuucagaggggaugucacccacaccacagguagucguaacuacacaaugaauuuggcuucucaaaauuggaacaauuaugacccaacagaagaaaucccagccccucuaggagcuccagauuuuguggggaagauucaaggcaugcucacucaaaccacaagggcagauggcucaacacgcggccacaaagcuacaguguacacugggagcgccgacuuugcuccaaaacugggcagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcaggaauacucauaauguucaucuggcccccgcuguagcccccacuuuuccgggugagcaacuucucuucuuuagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggagcggggcguagacguguauaa

SEQ ID NO: 7038 - RNA, 1620 nt, Artificial Sequence
  VP1__Norovirus_and/or_Norovirus-like__KX354025
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcaggugauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucagucaaaugaccccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauucccuauuccuuuggaaaaguuguucacgggucccagcagugccuuuguuguucaaccacaaaacggcaggugcacgacugauggcgugcuccuaggcaccacccaacugucuccugucaacaucugcaccuucagaggagaugucacccauaucacugguagucguaacuacacaaugaauuuggcuucucaaaauuggaacaauuaugacccaacagaagaaaucccagccccucuaggaacuccagauuuuguggggaagauucaaggcgugcucacccaaaccacaagggcagauggcucaacacgcggccacaaagcuacaguguacacugggagcgccgacuuugcuccaaaacuggguagaguucaauuugaaacugacacagaccaugauuuugaggcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuauuuuagguuugauuccugggucaaccaguucuacacgcuugcccccaugggaaauggaacggggcguagacguguguaa

SEQ ID NO: 7039 - RNA, 1620 nt, Artificial Sequence
  VP1__Norovirus_and/or_Norovirus-like__KJ685406
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaacaauuucuaucauuauaaucaaucaaaugaccccaccauuaaguugauagcaauguuguauacaccacuuagggcuaauaaugcuggggaugaugucuuuacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggagaugucacccauaucacugguagucguaacuacacaaugaauuuggcuucucaaaauuggaacaauuaugacccaacagaagaaaucccagccccucuaggaacuccagauuucguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucauacuggccaacaugauuugguuaucccccccaaugguuauuuuagguuugauuccugggucaaccaguucuacacgcuugcccccaugggaaauggaacggggcguagacguguguaa

SEQ ID NO: 7040 - RNA, 1620 nt, Artificial Sequence
  VP1__Norovirus_and/or_Norovirus-like__KF008241
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaacuucuaccauuacaaucaaucaaaugaccccacuauuaaguugauagcaauguuguauacaccacuuagggcuaauaaugcuggggacgaugucuucacagucucuugccggguccucacgagaccaucccccgacuuugauuucauauuucuagugccacccacaguugagucaagaacuaagccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucagcaucugcaccuucagaggggaugucacccacaucacagguagucguaacuacacaaugaauuuggcuucucaaaauuggaacaauuacgacccaacagaagaaaucccagccccucuaggaacuccagauuuuguagggaagauucaagguaugcucacccaaaccacaagggcagauggcucaacacgcggccacaaagcuacaguguacacugggagcgccgauuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuccucuucuucagauccaccaugcccggaugcagcggguaccccaauauggauuuggacugucugcucccccaggaaugggugcaguacuucuaccaagaggcagccccagcacaaucugauguggcucugcuaagauuugugaauccagacacagguaggguuuuguuugaguguaagcuucauaagucaggcuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7041 - RNA, 1620 nt, Artificial Sequence
  VP1__Norovirus_and/or_Norovirus-like__AB504327
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaagcgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauucccuuggaaaaauuguucacgggucccagcagugccuuuguuguucaaccacaaaauggcagaugcacgacugauggcgugcucuugggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaagauucaccccagucggugucauccaggaugguggcaccacccaccgaaaugaaccccaacagugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguguuuaa

SEQ ID NO: 7042 - RNA, 1620 nt, Artificial Sequence
  VP1__Norovirus_and/or_Norovirus-like__KY424329
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaacgguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguuuacgggucccagcagugccuuuguuguucaaccacaaaacggcaggugcacgacugauggcgugcuccuaggcaccacccaacugucuccugucaacaucugcaacuucagaggggaugucacccauaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuuuagauccaccaugcccggaugcagcggguaccccaacauggauuuggacugucugcucccccaggaaugggugcaguacuucuaccaagaggcagccccagcacaaucugacguggcucugcuaagauuugugaauccagacacagguaggguuuuguuugaguguaagcuucauaaaucaggcuauguuacaguggcucacacuggccaacaugauuugguuaucccccccaaugguuauuuuagguucgauuccugggucaaccaauucuacacgcuugcccccaugggaaauggaacggggcguagacguguauaa

SEQ ID NO: 7043 - RNA, 1620 nt, Artificial Sequence
  VP1__Norovirus_and/or_Norovirus-like__KT780389
augaagauggcgucgagugacgccaacccaucugauggguccgcagccaaccucgucccagaggucaacaaugagguuauggcucuggagcccguuguuggugccgccauugcggcaccuguggcgggccaacaaaauguaauugaccccuggauuagaaacaauuuuguacaagccccugguggagaguuuacaguguccccuagaaacgcuccaggugaaauacuauggagcgcgcccuuaggcccugauuuaaaccccuaccuaucccauuuggcuagaauguauaaugguuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaacuagaaccuguguugauucccuuacccgauguuaggaauaauuucuaucauuacaaucaaucaaaugaccccacuauuaaguugauagcaauguuguauacaccacuuagggcuaauaaugcuggggacgaugucuucacaguuucuugccgaguucucacgagaccaucccccgauuuugauuucauauuucuagugccacccacaguugagucuagaacuaaaccauucucugucccaguuuuaacuguugaggagaugaccaauucaagauuccccauuccuuuggaaaaguuguucacgggucccagcagugccuuuguuguucaaccacaaaacgguaggugcacgacugauggcgugcuccuaggcaccacccaauugucuccugucaacaucugcaccuucagaggggaugucacccacaucacagguagucguaacuacacaaugaauuuggcuucucaaaauuggaacaauuaugacccaacagaagaaaucccagcuccacuaggagcuccagauuuuguggggaagauucaaggcgugcucacccaaaccacaagggcagauggcucaacacgcggccacaaagcuacgguguacacugggagcgccgacuucgcuccaaaacugggcagaguucaauuugaaacugacacagaccaugauuuugaagcuaaccaaaacacaaaguucaccccagucggugucauccaagaugguagcaccacccaccgaaaugaaccccaacagugggugcucccaaguuacucagguagaaauacucauaauguucaucuggcccccgcuguagcccccacuuuuccgggugagcaacuucucuucuuuagauccaccaugcccggauguaguggguaccccaacauggauuuggacugucugcucccccaggaaugggugcaguacuucuaccaagaggcagccccagcacaaucugauguggcucugcuaagauuugugaauccagacacagguaggguuuuguuugaguguaaacuucauaaaucaggcuauguuacaguagcucacacuggccaacaugauuugguuaucccccccaaugguuauuuuagguuugauuccugggucaaccaguucuacacgcuugcccccaugggaaauggagcggggcguaaacguguauaa

SEQ ID NO: 7044 - RNA, 1620 nt, Artificial Sequence
  VP1__Norovirus_and/or_Norovirus-like__KX354134
augaagauggcgucgagugacgccaacccaucugauggguccgcagccaaccucgucccagaggucaacaaugagguuauggcucuggagcccguuguuggugccgccauugcggcaccuguagcgggccaacaaaaugucauugaccccuggauuagaaacaauuuuguacaagccccugguggggaguuuacaguauccccuagaaacgcuccaggugaaauacuauggagcgcgcccuuaggcccugaccuaaaucccuaccuaucccacuuggccaggauguacaaugguuaugcaggugguuuugaaguacagguaauucuugcggggaacgcguucaccgccgggaagaucauauuugcagcagucccaccaaauuucccaacugaaggcuugagcccuagccaggucacuauguucccccauauaauaguagauguuaggcaacuagaaccuguguugauccccuuacccgauguuaggaauaauuucuaucauuacaaucaaucaaaugauuccaccauuaaguugauagcaauguuguauacaccacuuagggcuaauaaugcuggggacgaugucuucacaguuuccugccgaguccucacgagaccgucccccgauuuugauuucauauuucuagugccacccacaguugagucaagaacuaaaccauucucugucccgaucuuaacuguugaggagaugaccaauucaagauuccccauucccuuggaaaaguuguucacgggucccagcagugccuuuguuguucaaccacaaaacggcagaugcacgacugauggcgugcuccuaggcaccacccaacugucuccugucaacaucugcaccuucagaggggauaucacccauaucacagguagucauaacuacacaaugaacuuggcuucccaaaacuggaacaguuacgauccaacagaagaaaucccagcuccucuagggacuccagauuuuguggggaagauucaaggugugcucacccaaaccacaagggcagauggcucgacacgcggccacaaggcuacaguguacacugggagcgccgacuuugcuccaaaacuggguaggguucaauuugaaacugacacaaaccaugauuuugaagccaaccaaaacacaaaguucaccccagucggcgucauccaagaugguagcaccacccaccgaaaugaaccccaacagugggugcucccaaguuacucgggcagaaauacucacaaugugcaccuggcccccgcuguagcccccacuuuuccgggcgagcaacuucucuucuucagguccacuaugcccggaugcagcggguaccccaacauggauuuggacugucugcucccccaggaaugggugcaguucuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuacuuuagguuugacuccuggguuaaucaguucuacacgcuugcccccaugggaaauggaacggggcguagacguguguaa

SEQ ID NO: 7045 - RNA, 1620 nt, Artificial Sequence
  VP1__Norovirus_and/or_Norovirus-like__KX354126
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacagugucccccagaaacgcuccaggugaaauacuauggagcgcgcccuuagguccugauuuaaaucccuaccuaucccauuuggccagaauguauaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucagucaaaugaccccacuauuaaguugauagcaauguuguauacaccacuuagggcuaauaaugcuggggacgaugucuucacaguuucuugccgaguucucacgagaccgucccccgauuuugauuucauauuucuagugccacccacaguugagucaagaacuaagccauucucugucccaguuuuaacuguugaggagaugaccaauucaagauuccccauuccuuuggaaaaguuguuuacgggucccagcagugccuuuguuguucaaccacaaaacggcaggugcacgacugauggcgugcuccuaggcaccacccaacugucuccugucaacaucugcaccuucagaggggacgucacccacaucacagguagucguaacuacacaaugaauuuggcuucucaaaauuggaacaauuacgacccaacagaagaaaucccagccccucugggaaccccagauuuuguagggaagauucaaggcaugcucacccaaaccacaagggcagauggcucaacacgcggccacaaagcuacaguguacacugggagcgccgauuuuucuccaaaacuggguagaguucaauuugaaacugacacagaccaugauuuugaagcuaaccaaaacacaaaguucaccccagucggugucauucaagaugguagcaccacccaccgaaaugaaccccaacagugggugcucccaaguuacucaggcagaaauacucauaaugugcaccuggcccccgcuguagcccccacuuuuccgggugagcaacuucucuucuucagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaaacuucauaaaucaggcuauguuacaguggcucacacuggccaacaugauuugguuaucccccccaaugguuauuuuagguuugauuccugggucaaccaguucuacacgcuugcccccaugggaaauggaacggggcguaaacguguauaa

SEQ ID NO: 7046 - RNA, 1620 nt, Artificial Sequence
  VP1__Norovirus_and/or_Norovirus-like__KR904237
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagagacaauuuuguacaagccccugguggggaguuuacaguauccccuagaaacgcuccaggugaaauacuauggagcgcgcccuuaggcccugauuuaaaucccuaccuaucccauuuggccagaauguacaaugguuaugcaggugguuuugaagugcagguaauccucgcggggaacgcguucaccgccgggaaggucauauuugcagcagucccaccaaauuuuccaacugaaggcuuaagccccagccagguuacuauguucccccauaugauaguagauguuaggcaacuagaaccugugcugauucccuuacccgauguuaggaauaauuucuaucauuacaaucaaucaaaugaccccacccuuaaguugauagcaauguuguauacaccacuuagggcuaauaaugcuggggacgaugucuucacaguuucuugccgaguccucacaagaccaucccccgauuuugauuucauauucuuggugccacccacaguugagucaagaacuaaaccauucucugucccaguuuuaacuguugaggagaugaccaauucaagguuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacaggcagucguaacuacacaaugaauuuggcuucucaaaauuggaacaauuaugacccaacagaagaaaucccagccccccuaggagcuccagauuuuguggggaagauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcacacacuggccaacaugauuugguuaucccccccaaugguuauuuuagguuugauucuugggucaaccaguucuacacgcuugcccccaugggaaauggaacggggcguagacguauauaa

SEQ ID NO: 7047 - RNA, 1620 nt, Artificial Sequence
  VP1__Norovirus_and/or_Norovirus-like__KP241911
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagaaccuguguugauucccuuacccgauguuaggaauaauuucuaccauuauaaccaaucaaaugaccccaccauuaaguugauagcaauguuguauacaccacuuagggcuaauaaugcuggggacgaugucuucacaguuucuugccgaguucucacaagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacaggcagucgcaacuacacaaugaauuuggcuucucaaaauuggaacaauuaugacccaacggaagaaaucccagccccucuaggaacuccagacuuuguggggaagauucaaggcaugcucacccaaaccacgaggacugauggcucaacacgcggccacaaagccacaguguacacugggagcgccgacuuugcuccaaaacuggguagaguucaauuugaaacugacacagaccaugauuuugaagcuaaccaaaauacaaaguucaccccagucggugucauccaagaugguagcaccacccaccgaaaugaaccccaacagugggugcucccaaguuacucaggcagaaauacucauaaugugcaucuggcccccgccguagcccccacuuuuccgggugagcaacuccucuucuucagauccaccaugcccggaugcagcggguaccccaacauggauuuggacugucugcucccccaggaaugggugcaguacuucuaccaagaggcagccccagcacaaucugauguggcacugcuaagauuugugaauccagacacagguaggguuuuguuugaguguaagcuucauaaaucagguuauguuacaguggcucacacuggccaacaugauuugguuaucccccccaaugguuauuuuagguuugauucuugggucaaccaguucuacacgcuugcccccaugggaaauggaacggggcguagacguguauaa

SEQ ID NO: 7048 - RNA, 1620 nt, Artificial Sequence
  VP1__Norovirus_and/or_Norovirus-like__KJ685411
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagaaccuguguugauucccuuacccgauguuaggaauaauuucuaucauuacaaccaaucaaaugaccccaccauuaaguugauagcaauguuguauacaccacuuagggcuaauaaugcuggggacgaugucuucacaguuucuugccgaguucucacaagaccaucccccgauuuugauuucauauuuuuagugccacccacaguugagucaagaacuaaaccauucucugucccaguuuuaacuguugaggagaugaccaauucaagauuccccauucccuuggagaaguuguucacgggucccagcagugccuuuguuguucaaccacaaaacggcaggugcacgacugauggcgugcuccuaggcaccacccaacugucuccugucaacaucugcaccuucagaggggaugucacccauaucacaggcagucgcaacuacacaaugaauuuggcuucucuaaauuggaacaauuaugacccaacagaagaaaucccagccccucuaggaacuccagacuuuguggggaagauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauucuugggucaaccaguucuacacgcuugcccccaugggaaauggaacggggcguagacguguauaa

SEQ ID NO: 7049 - RNA, 1620 nt, Artificial Sequence
  VP1__Norovirus_and/or_Norovirus-like__KF008242
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuugacuguugaggagaugaccaauucaagauuccccauuccuuuggaaaaguuguuuacgggucccagcagugccuuuguuguccaaccacaaaacggcaggugcacgacugauggcgugcuccuaggcaccacucaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuugugggaaagauucaaggcgugcucacccaaaccacaaggacagauggcucaacacgcggccacaaagcuacaguguacacugggagcgccgacuuugcuccaaaauuggguagaguucaauuugaaacugacacagaucaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguaaacguguauaa

SEQ ID NO: 7050 - RNA, 1620 nt, Artificial Sequence
  VP1__Norovirus_and/or_Norovirus-like__KF060112
augaagauggcgucgagugacgccaacccaucugauggguccgcagccaaccuugucccagaggucaacaaugagguuauggcucuggagcccguuguuggugccgccauugcggcaccuguagcgggccaacaaaaugugauugaccccuggauuagaaauaauuuuguacaagccccugguggagaguuuacaguguccccuagaaacgcuccaggugaaauacuauggagcgcgcccuuaggcccugaucuaaaucccuaccuaucccauuuggccaggauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggacgaugucuucacagucucgugccgaguucucacaagaccaucccccgacuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguacaaccacaaaauggcaggugcacaacugauggcgugcuccuaggcaccacccaacuaucuccugucaacaucugcaccuucagaggggaugucacccauaucacagguagucguaacuacacaaugaauuuggcuucucaaaauuggaacaauuaugacccaacagaagaaaucccagccccucuaggagcuccagauuuuguggggaagauucaaggcaugcucacccaaaccacaaggacagauggcucaacacgcggccacaaagcuacgguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacagucugauguggcucugcuaagauuugugaauccagacacagguaggguuuuguuugaguguaagcuucauaaaucaggcuaugucacaguggcucacacuggucaacaugauuugguuaucccccccaaugguuauuuuagguuugauucuugggucaaccaguucuacacgcuugcccccaugggaaauggaacggggcguagacguguauaa

SEQ ID NO: 7051 - RNA, 1620 nt, Artificial Sequence
  VP1__Norovirus_and/or_Norovirus-like__JX126912
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccaggauguacaauagcuaugcagguggcuuugaagugcagguaauccuugcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacggucucuugucgaguccucacgaggccaucccccgauuuugauuucauauucuuggugccacccacaguugagucaagaacuaaaccauucaccgucccaauuuuaacuguugaagaaaugaccaauucaagauucccuauuccuuuggaaaaguuguucacgggcccuagcggugccuuuguuguucaaccacaaaauggcaggugcacgacugauggcguacucuuaggcacuacccaacugucuccugucaacauuugcaccuucagaggggaugucacccacauugcaggcacucauaauuacacaaugaauuuggcuucucaaaauuggaacaauuaugacccaacagaagaaaucccagccccucuggggaccccagacuucgugggaaggauccaaggcaugcucacccaaaccacaaggggagauggcuccacccgcggccacaaagcuacagugagcacuggggauguccacuucacuccaaagcuggguaguauucaauucaacacugauacaaacaaugauuuugaaacuggccaaaacacgaaauucaccccagucgguguuauccaggauggcaaugguacccaccaaaaugaaccucaacaaugggugcucccaaguuacucagguagaacuggucauaauguacaccuagcccccgccguagcccccacuuuuccgggugagcagcuucuuuucuucagguccacuaugcccggaugcagcggguaccccaacaugaaucuggauugccuacucccccaagaaugggugcagcacuucuaucaagaggcagcuccagcacaaucugauguggcucugcuaagauuugugaauccagacacagguaggguucuauuugagugcaagcuccauaaaucaggcuacgucacaguugcucacacuggccagcaugauuugguuaucccccccaauggcuacuuuagauuugauuccugggucaaccaauucuacacacuugcccccaugggaaaugggacggggcgcagacguguauaa

SEQ ID NO: 7052 - RNA, 1620 nt, Artificial Sequence
  VP1__Norovirus_and/or_Norovirus-like__KX354143
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaauaauuuuguacaagccccugguggggaguuuacaguauccccuagaaacgcuccaggugaaauacuauggagcgcgccccuaggcccugaccuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaaguccuagccaggucacuauguucccccauauaauaguagauguuagacaauuagaaccugugcugauucccuuacccgaugucaggaauaauuucuaucauuacaaucagucaaaugacuccacuauuaaguugauagcaauguuguauacaccacuuagggcuaauaaugcuggggaugauguuuucacgguuucgugccgaguucucacgagaccaucccccgauuuugauuuuauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuucuaggcaccacccaacugucuccugucaacaucugcaccuucagaggggaugucacccacaucacagguagucgcaacuacacaaugaauuuggcuucucaaaauuggaacaacuaugacccaacagaagaaaucccagccccucuaggaacuccagauuuuguggggaagauccaaggcaugcucacccaaaccacaaggacagaugguucaacacgcggccacaaagcuauaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaacgaaccccaacagugggugcucccaaguuacucaggcagaaauacucacaauguacaucuggccccugcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguauaa

SEQ ID NO: 7053 - RNA, 1620 nt, Artificial Sequence
  VP1__Norovirus_and/or_Norovirus-like__KU985164
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccauuuggccagaauguauaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaaugcuguauacaccacuuagggcuaauaaugcuggggacgaugucuucacaguuucuugccgaguucucacgagaccaucccccgauuuugauuuuauauuucuagugccacccacaguugaaucuagaacuaaaccauucucugucccaguuuuaacuguugaggagaugaccaauucaagauuccccauuccuuuggaaaaguuguucacgggucccagcagugccuuuguuguucaaccacaaaacgguaggugcacgacugauggcgugcuccuaggcaccacccaauugucuccugucaacaucugcaccuucagaggggaugucacccacaucacagguagucguaacuacacaaugaauuuggcuucucaaaauuggaacaauuaugacccgacagaagaaaucccagccccucuaggagcuccagauuuuguggggaagauucaaggcaugcucacccaaaccacaagggcagauggcucaacacgcggccacaaagcuacaguguacacugggagcgccgacuucgcuccaaaacugggcagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaauguucaucuggcccccgcuguagcccccacuuuuccgggugaacaacuucucuucuuuagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaaacuccauaaaucaggcuauguuacaguggcucacacuggccaacaugauuugguuaucccccccaaugguuauuuuagguuugacuccugggucaaccaguucuacacgcuugcccccaugggaaauggagcggggcguagacguguauaa

SEQ ID NO: 7054 - RNA, 1620 nt, Artificial Sequence
  VP1__Norovirus_and/or_Norovirus-like__KX950760
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuaggaauaauuuuguacaagccccugguggagaguuuacaguauccccuagaaacgcuccgggugaaauacuauggagcgcgcccuuaggcccugaucuaaaucccuaccuaucccauuuggccagaauguacaaugguuaugcaggugguuuugaagugcagguacuucucgcggggaacgcguucaccgccgggaaggucauauuugcagcagucccaccaaauuucccaacugaaggcuuaagccccagccaggucacuauguucccccauauaguaguagauguuaggcaacuagaaccuguguugauucccuuacccgauguuaggaacaauuucuaccauuauaaccaaucaaaugacuccacuauuaaguugauagcaauguuguauacaccacuuagggcuaauaaugcuggggacgaugucuucacaguuucuugccgaguucucacaagaccaucccccgauuuugauuucauauuuuuaguaccacccacaguugagucaagaacuaaaccauucucuaucccaguuuuaacaguugaggagaugaccaauucaagauuccccauuccuuuggaaagguuguucacgggucccagcagcgccuuuguuguucaaccacaaaacggcagaugcacgacugauggcgugcuccuaggcaccacccaacuauccccugucaacaucugcaccuucagaggggacgucacccacaucacaggcagucgcaacuacacaaugaauuuggcuucucaaaauuggaacaauuacgacccaacagaagaaaucccagccccucuaggaacuccagacuuuguggggaagauucaagguaugcucacccaaaccacaagggcaaauggcucaacacgcggccacaaggcuacaguguacacuggaagcgccgacuuugcuccuaaacuggguagaguucaauuugaaacugacacaagugaugauuuugaaacuagccaaaacacaaaguucaccccagucggugucauccaagacgguagcaccaccccccgaaaugaaccccaacagugggugcucccaaguuacucaggcagaaauacucauaaugugcaucuggcccccgcuguggcccccacuuucccgggugagcaacuucucuucuucagauccaucaugcccggaugcagcggguacccuaacauggaucuggacugucuacucccucaggaaugggugcagcacuucuaccaagaggcagccccagcacaaucugauguggcucugcuaagauuuguaaauccagacacagguaggguuuuguuugagugcaagcuccauaaaucaggcuaugucacaguggcucacacuggccaacacgauuuggucaucccccccaaugguuauuuuagguuugauucuugggucaaccaguucuacacgcuugcccccaugggaaauggaacggggcguagacguguauaa

SEQ ID NO: 7055 - RNA, 1620 nt, Artificial Sequence
  VP1__Norovirus_and/or_Norovirus-like__KJ685402
augaagauggcgucgagugacgccaacccaucugauggguccgcagccaaccucgucccagaggucaacaaugagguuauggcucuggagcccguuguuggugccgccaucgcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagaaccuguguugauccccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacaagaccaucccccgauuuugauuucauauuuuuagugccacccacaguugagucaagaacuaaaccauucucugucccaguuuuaacuguugaggagaugaccaauucaagauuccccauuccucuggaaaaguuguucacgggucccagcggugccuuuguuguucaaccacaaaacggcaggugcacgacugauggcgugcucuuaggcaccacccaacugucuccugucaacaucugcaccuucagaggggaugucacccauaucacaggcagucgcaauuacacaaugaauuuggcuucucaaaauuggaacaauuaugacccaacagaggaaaucccagccccucuaggaacuccagacuuuguggggaagauucaaggcaugcucacccaaaccacaaggacagauggcucaacacgcggccacaaggcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauucuugggucaaccaguucuacacgcuugcccccaugggaaauggaacggggcguagacguguauaa

SEQ ID NO: 7056 - RNA, 1620 nt, Artificial Sequence
  VP1__Norovirus_and/or_Norovirus-like__KF060140
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgauaucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguauaa

SEQ ID NO: 7057 - RNA, 1620 nt, Artificial Sequence
  VP1__Norovirus_and/or_Norovirus-like__KX354132
augaagauggcgucgagugacgccaacccaucugauggguccgcagccaaccucgucccagaggucaacaaugagguuauggcucuggagcccguuguuggugccgccauugcggcaccuguagcgggccaacaaaaugucauugaccccuggauuagaaacaacuuuguacaagccccugguggggaguuuacaguauccccuagaaacgcuccaggugaaauacuauggagcgcgcccuuaggcccugaccuaaaucccuaccuaucccacuuggccaggauguacaaugguuaugcaggugguuuugaagugcagguaauucuugcggggaacgcguucaccgccgggaagaucauauuugcagcagucccaccaaauuucccaacugaaggcuugagcccuagccaggucacuauguucccccauauaauaguagauguuaggcaacuagaaccuguguugaucccuuuacccgauguuaggaauaauuucuaucacuacaaucaauuaaaugauuccaccauuaaguugauagcaauguuguacacaccacuuagggcuaauaaugcuggggacgaugucuucacaguuuccugucgaguccucacgagaccgucccccgauuuugauuucauauuucuagugccacccacaguugagucaagaacuaaaccauucucugucccgauuuuaacuguugaggagaugaccaauucaagauuccccauucccuuggaaaaguuguucacgggccccagcagugccuuuguuguucaaccacaaaacggcagaugcacgacugauggcgugcuccuaggcaccacccaacugucuccugucaacaucugcaccuucagaggggauaucacccauaccacagguagccacaacuacacaaugaacuuggcuucccaaaacuggaacaguuacgauccaacagaagaaaucccagcuccucuagggacuccagauuuuguggggaagauucaaggugugcucacccaaaccacaagggcagauggcucgacacgcggccacaaggcuacaguguacacugggagcgccgacuuugcuccaaaacuggguaggguucaauuugaaacugacacaaaccaugauuuugaagccaaccaaaacacaaaguucaccccagucggcgucauccaagaugguggcaccacccaccgaaaugaaccccaacagugggugcucccaaguuacucgggcagaaauacucacaaugugcaccuggcccccgcuguagcccccacuuucccgggcgagcaacuucucuucuucagguccacuaugcccggaugcagcggguaccccaacauggauuuggacugucugcucccccaggaaugggugcaguucuucuaccaagaggcagccccagcacaaucugauguggcucuguuaagauuuguaaauccagacacaggcaggguuuuauuugaguguaagcuucauaaaucaggcuauguuacaguggcucacacuggccaacaugauuugguuaucccccccaaugguuacuuuagguuugacuccuggguuaaucaguucuacacgcuugcccccaugggaaauggaacggggcguagacguguguaa

SEQ ID NO: 7058 - RNA, 1620 nt, Artificial Sequence
  VP1__Norovirus_and/or_Norovirus-like__KX354006
augaagauggcgucgagugacgccaacccaucugauggguccgcagccaaccucgucccagaggucaacaaugagguuauggcucuggagcccguuguuggugccgcuaucgcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuaggcaacuagagccuguguugauucccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuuuuggugccacccacaguugagucaagaaccaaaccauuuucugucccaguuuugacuguugaggagaugaccaauucaagauuccccauuccuuuggaaaaguuguucacaggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaagucccagccccucuaggaacuccagauuuuguggggaagauucaaggcaugcucacccaaaccacaaggacagauggcucaacacgcggccacaaagcaacaguguacacuggaagcgccgacuuuacuccaaaacuggguagaauucaauuugaaacugacacggaccaugauuuugaagcuaaccaaaacacaaaguucaccccagucggcguuauccaagaugguagcaccacccaccgaaaugaaccccaacagugggugcucccaaguuacucaggcagaaauacucauaaugugcauuuggccuccgcuguggcccccacuuuuccgggugagcagcuucucuucuucagguccaccaugcccggaugcagcggguaccccaacauggauuuggacugucugcucccucaggaaugggugcaguacuucuaccaagaggcagccccagcacaaucugauguggcucugcuaagauuugugaauccagacacagguaggguuuuguuugaguguaagcuucauaaaucaggcuauguuacaguggcuuacacuggccaacaugauuugguuaucccccccaaugguuauuuuagguuugauuccugggucaaccaguucuacacacuugcccccaugggaaauggaacggggcguagacguguauaa

SEQ ID NO: 7059 - RNA, 1620 nt, Artificial Sequence
  VP1__Norovirus_and/or_Norovirus-like__KX354145
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaauaauuuuguacaagccccugguggggaguuuacaguauccccuagaaacgcuccaggugaaauacuauggagcgcgccccuaggcccugaccuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaaguccuagccaggucacuauguucccccauauaauaguagauguuagacaauuagaaccugugcugauucccuuacccgaugucaggaauaauuucuaucauuauaaucagucaaaugauuccacuauuaaguugauagcaauguuguauacaccacuuagggcuaauaaugcuggggaugauguuuucacaguuucgugccgaguucucacgaggccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuccuaggcaccacccaacugucuccugucaacaucugcaccuucagaggggaugucacccacaucacagguagucgcaacuacacaaugaauuuggcuucucaaaauuggaacaacuaugacccaacagaagaaaucccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaucaaaacacaaaguucaccccagucggugucauccaagaugguagcaccacccaccgaaacgaaccccaacagugggugcucccaaguuacucaggcagaaauacucacaauguacaucuggcccccgcuguagcccccaccuucccgggugagcaacuucucuucuucagauccaccaugcccggaugcagcggguaccccaacauggauuuggacugucugcucccccaggaauggguacaguacuucuaccaagaggcagccccagcacaaucugauguggcucugcuaagauuugugaauccagacacagguaggguuuuguuugagugcaagcuucacaaaucaggcuauguuacaguggcucacacuggccaacaugauuugguuaucccccccaaugguuacuuuagguuugacuccugggucaaccaguucuacacgcuugccccuaugggaaauggaacggggcguagacguguauaa

SEQ ID NO: 7060 - RNA, 1620 nt, Artificial Sequence
  VP1__Norovirus_and/or_Norovirus-like__KX354140
augaagauggcgucgagugacgccagcccaucugauggguccgcagccaaccucguaccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguguccccuagaaacgcuccaggugaaauacuauggagcgcgccccuaggcccugaccuaaaccccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaaguccuagccaggucacuauguucccccauauaauaguagauguuagacaauuagagccugugcugauucccuuacccgaugucaggaauaauuucuaucacuauaaucaaucaaaugauuccacuauuaaguugauagcaauguuguauacaccacuuagggcuaauaaugcuggggacgaugucuucacaguuucgugccgaguucucacgagaccaucccccgauuuugauuucauauucuuagugccacccacaguugagucaagaacuaaaccauucucugucccagucuuaacuguugaggagaugaccaauucaagauuccccauuccuuuggaaaaguuguucacgggccccagcagugccuuuguuguucaaccacaaaacggcaggugcacaacugauggcgugcuccuaggcaccacccaacugucuccugucaacaucugcaccuucagaggggaugucacccacaucacagguagucgcaacuacacaaugaauuuggcuucucaaaauuggaacaacuaugacccaacagaagaaaucccagccccucuugcaacuccagauuuuguggggaagauucaaggcaugcucacccaaaccacaaggacagaugguucaacacguggccacaaagcuacaguguacacugggagcgccgacuuugcuccaaaacuggguagaguucaauuugaaacugacacagaccaugauuuugaagcuaaucaaaacacaaaguucaccccagucggugucauccaagaugguagcaccacccaccgaaacgaaccccaacagugggugcucccaaguuacucaggcagaaauacucacaauguacaucuggcccccgcuguagcccccaccuucccgggugagcaacuucucuucuucagauccaccaugcccggaugcagcggguaccccaacauggacuuggacugucugcucccccaggaaugggugcaguacuucuaccaagaggcagccccagcacaaucugauguagcucugcuaagauuugugaauccagacacagguaggguuuuguuugaaugcaagcugcacaaaucaggcuauguuacaguggcucacacuggccaacaugauuugguuaucccccccaaugguuacuuuagguuugauuccugggucaaccaguucuacacacuugcccccaugggaaauggaacggggcguagacguguauaa

SEQ ID NO: 7061 - RNA, 1620 nt, Artificial Sequence
  VP1__Norovirus_and/or_Norovirus-like__KX354119
augaagauggcgucgagugacgccaacccaucugauggguccgcagccaaccucgucccagaggucaacaaugagguuauggcucuggagcccguuguuggugccgccauugcggcaccuguagcgggccaacaaaaugucauugaccccuggauuagaaacaacuuuguacaagccccugguggggaguuuacaguauccccuagaaacgcuccaggugaaauacuauggagcgcgcccuuaggcccugaccuaaaccccuaccuaucccacuuggccaggauguacaaugguuaugcaggugguuuugaagugcagguaauucuugcggggaacgcguucaccgccgggaagaucauauuugcagcagucccaccaaauuucccaacugaaggcuugagcccuagucaggucacuauguucccccauauaauaguagauguuaggcaacuagaaccuguguugaucccuuuacccgauguuaggaauaauuucuaucacuacaaucaaucaaaugauuccaccauuaaguugauagcaauguuguauacaccacuuagggcuaauaaugcuggggacgaugucuucacaguuuccugucgaguccucacgagaccgucccccgauuuugauuucauauuucuagugccacccacaguugagucaagaacuaaaccauucucugucccgauuuuaacuguugaggagaugaccaauucaagauuccccauucccuuggaaaaguuguucacgggccccagcagugccuuuguuguucaaccacaaaacggcagaugcacgacugauggcgugcuccuaggcaccacccaacugucuccugucaacaucugcaccuucagaggggauaucacccauaucacagguagucauaacuacacaaugaacuuggcuucccaaaacuggaacaguuacgauccaacagaagaaaucccagcuccucuagggacuccagauuuuguggggaagauucaaggugugcucacccaaaccacaagggcagauggcucgacacgcggccacaaggcuacaguguacacugggagcgccgacuuugcuccaaaacuggguaggguucaauuugaaacugacacaaaccaugauuuugaagccaaccaaaacacaaaguucaccccagucggcgucauccaagaugguggcaccacccaccgaaaugaaccccaacagugggugcucccaaguuacucgggcagaaauacucacaaugugcaccuggcccccgcuguagcccccacuuucccgggcgagcaacuucucuucuucagguccacuaugcccggaugcagcggguaccccaacauggauuuggacugucugcucccccaggaaugggugcaguucuucuaccaagaggcagccccagcacaaucugauguggcucuguuaagauuuguaaauccagacacaggcaggguuuuauuugaguguaagcuucauaaaccaggcuauguuacaguggcucacacuggccaacaugauuugguuaucccccccaaugguuacuuuagguuugacuccuggguuaaucaguucuacacgcuugcccccaugggaaauggaacggggcguagacguguguaa

SEQ ID NO: 7062 - RNA, 1620 nt, Artificial Sequence
  VP1__Norovirus_and/or_Norovirus-like__KX354018
augaagauggcgucgagugacgccaacccaucugauggguccgcagccaaccucguaccagaggucaacaaugagguuauggcucuggagcccguuguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaacaauuucuaucauuauaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccaguagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacguggccacaaagcuacaguguacacugggagcgccgacuuugcuccaaaacuggguagaguucaauuugaaacugacacagaccaugauuuuggagcuaaucaaaacacaaaguucaccccagucggugucauccaagaugguagcaccacccaccgaaaugaaccccaacagugggugcucccaaguuacucaggcagaaacacucauaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuacuuuagguuugauuccugggucaaccaguucuacacgcuugcccccaugggaaauggaacggggcguagacguguauaa

SEQ ID NO: 7063 - RNA, 1620 nt, Artificial Sequence
  VP1__Norovirus_and/or_Norovirus-like__AB972499
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugagauacuauggagcgcgcccuuaggcccugaucuaaaucccuaccuuucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacgaugaauuuggcuucucaaaauuggaacaauuaugacccaacagaagaaaucccagccccucuagggacuccagauuuuguggggaaaauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7064 - RNA, 1620 nt, Artificial Sequence
  VP1__Norovirus_and/or_Norovirus-like__KF060142
augaagauggcgucgagugacgccaacccaucugauggguccgcagccaaccucguaccagaggucaacaaugagguuauggcucuggaucccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccgggugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuaugucacaguggcucacacuggccaacaugauuugguuaucccccccaaugguuacuuuagguuugauuccugggucaaccaguucuacacgcuugcccccaugggaaauggaacggggcguagacguguauaa

SEQ ID NO: 7065 - RNA, 1620 nt, Artificial Sequence
  VP1__Norovirus_and/or_Norovirus-like__KF060138
augaagauggcgucgagugacgccaacccaucugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcaaugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaccaaaacacaaaguuuaccccagucggugucauccaagaugguagcacuacccaccgaaaugaaccccaacagugggugcucccaaguuacucaggcagaaauacucauaauguacaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguauaa

SEQ ID NO: 7066 - RNA, 1620 nt, Artificial Sequence
  VP1__Norovirus_and/or_Norovirus-like__KP784697
augaagauggcgucgagugacgccaacccaucugauggguccgcagccaaccucgucccagaggucaacaaugagguuauggcucuggagcccguuguuggugccgccaucgcggcaccuguagcgggccaacaaaauguaauugaccccuggauuagaaacaauuuuguacaagccccugguggagaauuuacaguauccccuagaaacgcuccaggugaaauacuauggagcgcgcccuuaggcccugauuuaaaucccuaccuaucccauuuggccagaauguacaaugguuaugcaggugguuuugaagugcagguaauccucgcggggaacgcguucaccgccgggaaggucauauuugcagcagacccaccaaauuuuccaacugaaggcuuaagccccagccagguuacuauguucccccauaugauaguagauguuaggcaacuagaaccuguguugauucccuuacccgauguuaggaauaauuucuaccauuacaaucaaucaaaugaccccacccuuaaguugauagcaauguuguauacaccacuuagggcuaauaaugcuggggacgaugucuucacaguuucuugucgaguccucacaagaccaucccccgauuuugauuucauauucuuggugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggauaucacccauaucacagguagucgcaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucacuccagucggugucauccaagaugguagcaccacccaccgaaaugaaccccaacagugggugcucccaaguuacucaggcagaaauacucauaaugugcaucuggcccccgccguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauucuugggucaaccaguucuacacgcuugcccccaugggaaauggaacggggcguagacguguauaa

SEQ ID NO: 7067 - RNA, 1620 nt, Artificial Sequence
  VP1__Norovirus_and/or_Norovirus-like__KF060111
augaagauggcgucgagugacgccaacccaucugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcagcuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguauaa

SEQ ID NO: 7068 - RNA, 1620 nt, Artificial Sequence
  VP1__Norovirus_and/or_Norovirus-like__KF060089
augaagauggcgucgagugacgccaacccaucugauggguccgcagccaaccucgucccagaggucaauaaugagguuauggcucuggagcccguuguuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuagguccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuagacaacuagaaccugugcugauucccuuacccgaugucaggaauaacuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccucuggaaaaguuguucacgggccccagcagugccuuuguuguucaaccacaaaacggcaggugcacgacugauggcgugcuccuaggcaccacccaacugucuccugucaauaucugcaccuucagaggggaugucacccacaucacagguagucguaacuacacaaugaauuuggcuucucaaaauuggaacaauuaugacccaacagaagaaaucccagccccucuagggacuccagauuuuguggggaagauucaaggcaugcucacccaaaccacaaggacagauggcucgacacgcggccacaaagcuacaguguacacugggagcgccgacuuugcuccaaaacuggguagaguucaauuugaaacugacacagaccaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaagcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7069 - RNA, 1620 nt, Artificial Sequence
  VP1__Norovirus_and/or_Norovirus-like__KP096333
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaacgguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccagucuuaacuguugaggagaugaccaauucaagguuccccauuccuuuggaaaaguuguucacgggccccaguagugccuuuauuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaccccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaacagguuauguuacaguggcucacacuggccaacaugauuuaguuaucccccccaaugguuauuuuagauuugauuccugggucaaccaguucuacacacuugcccccaugggaaaugggacggggcguagacguguauaa

SEQ ID NO: 7070 - RNA, 1620 nt, Artificial Sequence
  VP1__Norovirus_and/or_Norovirus-like__KF060153
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaaguggagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccagcugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguauaa

SEQ ID NO: 7071 - RNA, 1620 nt, Artificial Sequence
  VP1__Norovirus_and/or_Norovirus-like__KF060125
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggcuagaauguacaaugguuaugcaggugguuuugaaguggagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcacgcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguauaa

SEQ ID NO: 7072 - RNA, 1620 nt, Artificial Sequence
  VP1__Norovirus_and/or_Norovirus-like__KX354135
augaagauggcgucgagugacgccaacccaucugauggguccgcagccaaccucgucccagaggucaacaaugagguuauggcucuggagcccguuguuggugccgccauugcggcaccuguagcgggccaacaaaaugucauugaccccuggauuagaaacaacuuuguacaagccccugguggggaguuuacaguauccccuagaaacgcuccaggugaaauacuauggagcgcgcccuuaggcccugaccuaaaccccuaccuaucccacuuggccaggauguacaaugguuaugcaggugguuuugaagugcagguaauucuugcggggaacgcguucaccgccgggaagaucauauuugcagcagucccaccaaauuucccaacugaaggcuugagcccuagccaggucacuauguucccccauauaauaguagauguuaggcaacuagaaccuguguugaucccuuuacccgauguuaggaauaauuucuaucacuacaaucaaucaaaugauuccaccauuaaguugauagcaauguuguauacaccacuuagggcuaauaaugcuggggacgaugucuucacaguuuccugucgaguccucacgagaccgucccccgauuuugauuucauauuucuagugccacccacaguugagucaagaacuaaaccauucucugucccgauuuuaacuguugaggagaugaccaauucaagauuccccauucccuuggaaaaguuguucacgggccccagcagugccuuuguuguucaaccacaaaacggcagaugcacgacugauggcgugcuccuaggcaccacccaacugucuccugucaacaucugcaccuucagaggggauaucacccauaucacagguagucauaacuacacaaugaacuuggcuucccaaaacuggaacaguuacgauccaacagaagaaaucccagcuccucuagggacuccagauuuuguggggaagauucaaggugugcucacccaaaccacaagggcagauggcucgacacgcggccacaaggcuacaguguacacugggagcgccgacuuugcuccaaaacuggguaggguucaauuugaaacugacacaaaccaugauuuugaagccaaccaaaacacaaaguucaccccagucggcgucauccaagaugguggcaccacccaccgaaaugaaccccaacagugggugcucccaaguuacucgggcagaaauacucacaaugugcaccuggcccccgcuguagcccccacuuucccgggcgagcaacuucucuuccuuaaguccacuaugcccggaugcagcggguaccccaacauggauuuggacugucugcucccccaggaaugggugcaguucuucuaccaagaggcagccccagcacaaucugauguggcucuguuaagauuuguaaacccagacacaggcaggguuuuauuugaguguaagcuucauaaaucaggcuauguuacaguggcucacacuggccaacaugauuugguuaucccccccaaugguuacuuuagguuugacuccuggguuaaucaguucuacacgcuugcccccaugggaaauggaacggggcguagacguguguaa

SEQ ID NO: 7073 - RNA, 1620 nt, Artificial Sequence
  VP1__Norovirus_and/or_Norovirus-like__KX354045
augaagauggcgucgagugacgccaacccaucugauggguccgcagccaaccucguaccagaugucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaguucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaacaauuucuaucauuauaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaucaaaacacaaaguucaccccagucggugucauccaagaugguagcaccacccaccgaaaugaaccccaacagugggugcucccaaguuacucaggcagaaacacucauaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuacuuuagguuugauuccugggucaaccaguucuacacgcuugcccccaugggaaauggaacggggcguagacguguauaa

SEQ ID NO: 7074 - RNA, 1620 nt, Artificial Sequence
  VP1__Norovirus_and/or_Norovirus-like__LC153121
augaagauggcgucgagugacgccaacccaucugauggguccgcagccaaccucguaccagaggucaacaaugagguuauggcuuuggagcccguugucggugccgcuauugcggcaccuguagcgggccaacaaaauguaauugaccccuggauuagaaauaauuuuguacaagccccugguggggaguuuacaguauccccuagaaacgcuccaggugaaauacuauggagcgcgccccuaggcccugaccuaaaucccuaccuaucucauuuggccagaauguauaaugguuaugcaggugguuuugaagugcagguaauucucgcggggaacgcguucaccgccgggaagaucauauuugcagcagucccaccaaauuuuccaacugaaggcuuaaguccuagccaggucacuauguucccccauauaauaguagauguuagacaauuagaaccugugcugauccccuuacccgaugucaggaauaauuucuaucauuacaaucagucaaaugauuccacuauuaaguugauagcaauguuguauacaccacuuagggcuaauaaugcuggggaugauguuuucacaguuucgugccgaguucucacgaggccaucccccgauuuugauuuuauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuccuaggcaccacccaacugucuccugucaacaucugcaccuucagaggggaugucauccacaucacagguagucgcaacuacacaaugaauuuggcuucucaaaauuggaacaacuaugacccaacagaagaaaucccagccccucuaggaacuccagauuuuguggggaagauucaagguaugcucacccaaaccacaaggacagaugguucaacacgcggccacaaagcuacaguguacacugggagcgccgacuuugcuccaaaacuggguagaguccaauuugaaacugacacagaccacgauuuugaagcuaaucaaaacacaaaguucaccccagucggugucauccaagaugguagcaccacccaccgaaacgaaccccaacagugggugcucccaaguuacucaggcagaaauacucacaauguacaucuggcccccgcuguagcccccaccuucccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguguauaa

SEQ ID NO: 7075 - RNA, 1620 nt, Artificial Sequence
  VP1__Norovirus_and/or_Norovirus-like__KF668568
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcaaucccaccaaauuuuccaacugaaggcuuaagucccagccaggucacuauguucccccacauaguaguagauguuaggcaacuagaaccuguguugauucccuuacccgauguuaggaauaauuucuaucauuauaaccaaucaaaugaccccaccauuaaguugauagcaauguuguauacaccacuuagggcuaauaaugcugggggcgaugucuucacaguuucuugccgaguucucacaagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguacacuggaagcgccgacuuugcuccaaaacuggguagaguucaauuugaaacugacacagaccaugauuuugaagcuaaccaaaucacaaaguucaccccaaucggugucauccaagaugguagcaccacccaccgaaaugaaccccaacagugggugcucccaaguuacucaggcagaaauacucauaaugugcaucuggcccccgcuguagcucccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauucuugggucaaccaguucuacacgcuugcccccaugggaaauggaacggggcguagacguguauaa

SEQ ID NO: 7076 - RNA, 1620 nt, Artificial Sequence
  VP1__Norovirus_and/or_Norovirus-like__KF668567
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccacauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggacgaugucuccacaguuucuugccgaguucucacaagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaaucggugucauccaagaugguagcaccacccaccgaaaugaaccccaacagugggugcucccaaguuacucaggcagaaauacucauaaugugcaucuggcccccgcuguagcucccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauucuugggucaaccaguucuacacgcuugcccccaugggaaauggaacggggcguagacguguauaa

SEQ ID NO: 7077 - RNA, 1620 nt, Artificial Sequence
  VP1__Norovirus_and/or_Norovirus-like__KR904210
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaaccaaaccauucucugucccaauuuuaacuguugaggagaugaccaauucaagguuccccauucccuuggaaaaguuguucacgggccccaguagugccuuuguuguccaaccacaaaacggcaggugcacgacugauggcgugcuccuagguacuacccaacugucuccugucaauaucugcaccuucagaggggaugucacccauauugcaggcagucguaacuacacaaugaaucuggcuucccaaaauuggaacaguuaugacccaacagaagaaaucccagccccucuagaaaccccagauuucguggggaagauucaaggugugcucacccaaaccacaaggacagauggcucgacccgcggccacaaagcuacaguguacacugggagcgccgacuuuucuccaaaacuggguagaguucaauuugccacugacacagacaaugauuucgauucuaaccaaaacacaaaguucaccccagucgguguuauccaggauggugguacuacccaccgaaacgaaccccaacaaugggugcucccaaguuacucaggcagagauauucauaaugugcaccuggcccccgcuguagcucccacuuuuccgggugagcaacuccucuuuuucagaucuaccaugcccggaugcagcggguaccccaacauggauuuggacugucugcucccccaggaaugggugcaguauuucuaccaggaagcagccccagcacaaucugauguggcucuguuaagauuugugaauccagacacagguaggguuuuguuugaguguaagcuucauaaaucaggcuauguuacaguggcccacacuggccaacaugauuugguuaucccccccaaugguuauuuuagauuugauuccugggucaaccaguucuacacacuugcccccaugggaaaugggacggggcgcagacguguuuaa

SEQ ID NO: 7078 - RNA, 1620 nt, Artificial Sequence
  VP1__Norovirus_and/or_Norovirus-like__JX459907
augaagauggcgucgagugacgccaacccaucugauggguccgcagccaaccucgucccagaggucaauaaugagguuauggcucuggagcccguuguuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuagguccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuagacaacuagaaccugugcugauucccuuacccgaugucaggaauaacuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccucuggaaaaguuguucacgggccccagcagugccuuuguuguucaaccacaaaacggcaggugcacgacugauggcgugcuccuaggcaccacccaacugucuccugucaauaucugcaccuucagaggggaugucacccacaucacagguagucguaacuacacaaugaauuuggcuucucaaaauuggaacaauuaugacccaacagacgaaaucccagccccucuagggacuccagauuuuguggggaagauucaaggcaugcucacccaaaccacaaggacagauggcucgacacgcggccacaaagcuacaguguacacugggagcgccgacuuugcuccaaaacuggguagaguucaauuugaaacugacacagaccaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaagcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguguauaa

SEQ ID NO: 7079 - RNA, 1620 nt, Artificial Sequence
  VP1__Norovirus_and/or_Norovirus-like__KF060062
augaagauggcgucgagugacgccaacccaacugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaaccgaaggcuuaagccccagccaggucacuauguucccccacauaauaguagauguuagacaauuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaccccagccccucuaggaacuccagauuuuguggggaagauucaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuucagguuugauuccugggucaaccaguucuacacgcuugcccccaugggaaauggaacggggcguagacguguauaa

SEQ ID NO: 7080 - RNA, 1620 nt, Artificial Sequence
  VP1__Norovirus_and/or_Norovirus-like__KF060080
augaagauggcgucgagugacgccaacccaucugauggguccgcagccaaccucgucccagaggucaauaaugagguuauggcucuggagcccguugcuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuagguccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuuaagccccagccaggucacuauguucccccauauaguaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccucuggaaaaguuguucacgggccccagcagugccuuuguuguucaaccacaaaacggcaggugcacgacugauggcgugcuccuaggcaccacccaacugucuccugucaauaucugcaccuucagaggggaugucacccacaucacagguagucguaacuacacaaugaauuuggcuucucaaaauuggaacaauuaugacccaacagaagaaaucccagccccucuagggacuccagauuuuguggggaagauucaaggcaugcucacccaaaccacaaggacagauggcucgacacgcggccacaaagcuacaguguacacugggagcgccgacuuugcuccaaaacuggguagaguucaguuugaaacugacacagaccaugauuuugaagcuaaccaaaacacaaaguucaccccagucgguguuauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaagcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugacuccugggucaaccaguucuacacgcuugcccccaugggaaauggaacggggcguagacguguauaa

SEQ ID NO: 7081 - RNA, 1620 nt, Artificial Sequence
  VP1__Norovirus_and/or_Norovirus-like__KF378731
augaagauggcgucgagugacgccaacccaucugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccauuuggcuagaauguacaaugguuaugcaggugguuuugaagugcagguaauucucgcggggaacgcguucgccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugauuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcacccucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacucaaaccacaaggacagaugguucaacacgcgguuacaaagcuacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccagcagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaggaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaacgguuacuuuagguuugauuccugggucaaccaguucuacacgcuugcccccaugggaaauggaacggggcguagacguguauaa

SEQ ID NO: 7082 - RNA, 1620 nt, Artificial Sequence
  VP1__Norovirus_and/or_Norovirus-like__AB933731
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaauuauauuugcagcagucccaccaaacuucccaacugaagguuugagccccagccaggucacuauguucccccacauaauaguagauguuaggcaauuggaaccuguguugauccccuuacccgauguuaggaauaacuucuaccauuauaaucaaucaaaugaccccaccaucaaauugauagcaauguuguacacaccacuuagggcuaauaacgccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaaagguuucccccauucccuugaaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccaccgacacagacaaugauuuugaaacuaaccaaaacacaaaguucaccccagucgguguuauucaggaugguaguacuaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7083 - RNA, 1620 nt, Artificial Sequence
  VP1__Norovirus_and/or_Norovirus-like__AB933749
augaagauggcgucuaacgacgucaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgucgugagaaucauauuuucagcagucccaccaaauuucccaacugaaggucugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugccgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggagaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaaugguucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggaugguaguacuaccccccgaaaugaaccccaacaaugggugcuuccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggucaacaugauuugguuaucccccccaaugguuauuuuagauuugauuccuggguuaaccaguucuacacacuugcccccaugggaaaugggacggggcguagacguuaa

SEQ ID NO: 7084 - RNA, 1620 nt, Artificial Sequence
  VP1__Norovirus_and/or_Norovirus-like__KC517370
augaagauggcgucgagugacgccaacccaucugauggguccgcagccaaccucgucccagaggucaacaaugagguuauggcucuggagcccguuguuggugccgccauugcggcaccuguagcgggccaacaaaaugugauugaccccuggauuagaaacaauuuuguacaagccccugguggagaguuuacaguguccccuagaaacgcuccaggugaaauacuguggagcgcgcccuuaggcccugaucuaaaucccuaccuuucccauuuggccagaauguacaaugguuaugcaggugguuuugaagugcagguaauucucgcggggaacgcguucaccgccgggaaggucauauuugcagcagucccaucaaauuuuccaacugaaggcuuaagccccagccaggucacuauguucccccauauaauaguagauguuagacaacuagaaccugugcugauccccuuacccgaugucaggaauaauuucuaucauuacaaucaaucaaaugacuccacuauuaaguugauagcaauguuguauacacuacuuagggcuaauaaugcuggggacgaugucuucacaguuucuugccgaguucucacgagaccaucccccgauuuugauuucauauuuuuagugccacccacaguugagucaagaacuaaaccauuuucugucccaguuuuaacuguugaggagaugaccaauucaagauuucccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuagggacuccagauuuuguggggaagauucaaggcaugcucacccaaaccacaaggacagauggcucaacacgcggccacaaagcuacaauguacacugggagcgccgacuuugcuccaaaacuggguagaguucaauuugaaacugacacagaccaugauuuugaagcuaaccaaaacacaaaguucaccccagucgguguuauccaagacgguggcaccacccaccgaaaugaaccccaacagugggugcucccaagcuacucaggcagaaauacucauaaugugcaucuggcccccgcuguagcccccacuuuuccgggugagcaacuucucuucuucagacccaccaugcccggaugcagcggguaccccaacauggauuuggaccgucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagguuugauuccugggucaaccaguucuacacgcuugcccccaugggaaauggaacggggcguagacguguauaa

SEQ ID NO: 7085 - RNA, 1620 nt, Artificial Sequence
  VP1__Norovirus_and/or_Norovirus-like__EF547396
augaugauggcgucuaaggacgccccaacaaacauggauggcacuaguggugccggucagcugguaccagaggcaaauacagcugaaccuauaucaauggacccaguggcuggagccgcaacagcgguugcaacugcuggacaaauuaauaugauugaccccuggauaaugaguaauuuugugcaggccccacaaggggaguuuaccgucucaccaaauaacaccccuggagauguuuuauuugaucuacaauugggaccucaauuaaauccauuccucgcccaucuagcccaaauguauaaugguuggguaggcaauaugcgcgugaaggugcugcuugcuggcaacgcuuuuaccgcagggaaaauaauaauuaguugcauacccccaggcuucaccucccagaacauuuccauugcucaaaugacaauguucccucaugucaucgcugacgugaggguuuuggaaccuauagaaguaccccuugaggaugugaggaaugugcuguuucacaccaaugacaaccguccaacaaugaggcucguguguauguuguacacccccuugcgagcuaauggcaguucuucuggcacggacccuuuugucauagcugguaggguucuuacuugcccggauucaaauuuuaguuuccuauuuuuaguacccccuaauguagaacaaaagacuaggccuuuuaguguccccaacauaccuuugaacacauugucaaauucgagggugccaucauugaucaagucuaugacuaucucuagagaucagaaucagauaauucaguuccaaaauggcagggucacauuggauggucagcugcagggcaccacaccuacaucagugagccaauuguguaaaauuagaggcacuacauaucacgcaacuggagguaaugggauaaauuuaacagaguugaauggugaaccauaccaugccuuugaaagccccgccccaauaggauucccagaucuuggugguugugauuggcaucucacugcaacccccacgcaagcuuucaacgauggagcgaaggucgugcgccugucagucacccagggcgcagcuuuugccccacauuuagguaccauacauuacaccacuacugauacugauuauagccccaacacuaguauaauuugcacacuagauuggcugucccaaacuacuggccagagcaauguugaccccuggcagauaccaacuuaugggucgacuuuaacugaagccgcccaguuggcaccucccaucuuucccccuggguuuggagaaacauuggucuucuucuuaucagauuuuccuauuuccaauggcaaaaauggacucaguguaccgugcacccucccacaggaauuugucacccacuuugugaaugagcaggccccaaucagaggagaggccgcucuuuugcauuauguugauccugacacucaccgcaaucuuggagaguuuaaauuguauccagaagguuuuaugacuuguguuccuaauacuagugguggugguccucaaacuuugccuauuaauggagucuuugucuuuguuucuugggucucucgcuuuuaccaguugaagccugugggaacggccggugcggcucguaggcuuuaa

SEQ ID NO: 7086 - RNA, 1620 nt, Artificial Sequence
  VP1__Norovirus_and/or_Norovirus-like__JN699047
augaugauggcgucuaaggacgccccaacaaacauggauggcaccaguggugccggucagcugguaccagaggcaaauacagcugaaccuauaucaauggauccaguggcuggagccgcaacagcgguugcaacugcuggacaaauuaauaugauugaccccuggauaaugaguaauuuugugcaagccccacaaggggaguucacugucucaccaaauaauaccccuggagaugucuuauuugaucuacaauugggaccccaauuaaauccauuccucgcccaucuagcccagauguauaacgguuggguaggcaauaugcgugugaaggugcugcuugccggcaacgcuuucaccgcagggaagauaauaauuaguugcauaccuccagguuucaccucccaaaacauuuccauugcucaaaugacaauguucccucaugucaucgcugacgugagggucuuggaaccuauagaaauaccccuagaggaugugaggaaugugcuguuucacaccaaugacaaccguccaacaaugaggcucguguguaugcuguacacuccuuugcgagccaauggcaguucuucugguacggauccuuuugucauagcuggcaggguucucaccugcccagauucaaauuuuaguuuucuauuuuuaguaccccccaauguggaacaaaagacuaggccuuucaguguccccaauauaccuuugaacacacuaucaaauucaagggugccaucauugaucaagucuaugacuauuucuagagaucagaaucagauuauucaauuucaaaauggcagaguuacauuggauggucagcuacagggcaccacaccuacaucagugagccaguuguguaaaauuagagguacuacguaucaugcaacuggagguaaugggauaaauuuaacagaauugaauggugaaccauaccaugcuuuugaaagucccgccccaauaggauucccagaucuuggugguugugauuggcaucuuacagcaacccccacgcaggcuuuuaacgauggagcaaaagucgugcgccugucagucacccagggcgcagcuuuugccccacauuuaggcaccauacauuacacuacaacugaccaugauuaugaccccaauacuagcauaauuuguacauuagauugguugucccaaacuacuggucaaaacaauguugaucccuggcaaauaccgacuuaugggucaacuuuaacugaagccgcccaguuggcaccacccaucuucccuccuggguuuggagaaacauugguuuucuuucuaucagacuuccccaucuccaauggcaaaaaugggcucaguguaccaugcacccuuccacaagaauuugucacccauuuugugaaugagcaggccccaauuagaggagaggccgcccuuuugcauuauguugauccagacacucaccgcaaucuuggagaguuuaaauuguauccagaaggcuuuaugacuugugucccuaacacuaguggugguggcccccaaacuuugccuaucaauggagucuuugucuuuguuucuugggucucucgcuuuuaucaguugaagccugugggaacggccggugcggcucguaggcuuuaa

SEQ ID NO: 7087 - RNA, 1620 nt, Artificial Sequence
  VP1__Norovirus_and/or_Norovirus-like__KT781411
augaugauggcgucuaaggacgccccaacaaacauggauggcaccaguggugccggccagcugguaccagaggcaaauacagcugagccuauuucaauggaaccaguagcuggggcugcgacagcagccgcaacugcuggacaaguaaauaugauugaccccuggauaaugaauaacuauguacaagccccucaaggagaguucaccauuucgccuaauaacacuccuggugacauuuuauuugaccuacaauugggcccacaucucaacccuuucuugucccauuuggcacaaauguacaaugguugggucggaaacaugaaagugaaggugcuuuuggcuggcaaugccuucacagcugggaagauuauaauuaguugcauacccccuggcuuugcuucacaaaauauuuccauagcucaagcuacaauguucccccaugucauugcagaugucagagugcuugaaccuauagaaguuccccuugaggauguuagaaaugugcucuuucauaauaaugauaauuccccuacuaugagauuggucugcauguuauauacaccucuuagggcuagugguagcucaucagguacugacccauuugucauugcaggaaggguccugacuugcccgagcccggauuuuagcuucuuguuucugguccccccgaauguagaacagaaaaccaagcccuucucugugcccaacuugccacuaaauacacucuccaacucaaggguuccuucacuuaucaaugcuaugaugauuuccagagaccaugggcagauggugcaguuccaaaauggcagggucacacuugauggccagcugcaggguacaaccccuaccucauugagccaacuauguaagauuagagggaaagucuuccuugcuaguggaggcaauggucugaaucucacugaauuggauggaucugcuuaucaugccuuugaaaguccugcuccaauuggguucccagauauuggugauugugauuggcacaugaacgccacagcuacuagcaauuucacuggguccaacgaugagcaccaaauacuugucaaacaagagucaacauuugccccccaucuuggucaugugcaggcugaccaccuaccggaaguugcuaacacugaccuuauggugucuuugaguuggauauccccuguuucagaccaacacaggcgugacguggacccaugggucauaccgcguuauggcucuacccucacugaagcugcacaguuggccccgccuauuuauccuccuggauuuggugaagcuauaguguucuuuaugucugauuuuccaguggugucggguguuaaugguaugaggauuccaugcacacuaccucaggaauauguggcucauuuuguaaaugagcaggcccccacucgaggugaggcagcucucuugcauuauguugauccugacacucacagaaaccuaggugaguuuaaaaucuauccugagggcuuuaugaccugugugccuaacuccaguggaacuggcccucagaccuuaccuauuaauggagucuuuacuuuuguuucuuggguuucucguuucuaucaauuaaagccugugggaacugcugguccagcacguaggcuuuaa

SEQ ID NO: 7088 - RNA, 1620 nt, Artificial Sequence
  VP1__Norovirus_and/or_Norovirus-like__U04469
augaugauggcgucuaaggacgccccaacaaacauggauggcaccaguggugccggccagcugguaccagaggcaaacacagcugagccuauuucaauggagccaguggcuggggcugcgacagcagccgcaacugcuggacaaguaaauaugauugaccccuggauaaugaguaauuauguacaagcuccucaaggagaauuuaccauaucgcccaacaauacacccggugacauuuuauuugaccugcaauugggcccacaccucaauccuuucuugucccauuuagcucaaauguacaaugguuggguuggaaauaugagagugaaggugcuuuuggcugguaaugcuuuuacagcugggaaaauuauaauuaguugcauacccccuggcuuugcugcgcaaaauauuuccauagcucaagcuacaauguucccccaugucauugcagauguuagggugcuugaaccuauagaggucccucuugaagauguuagaaaugugcuuuuccacaauaaugauaguucccccacuaugagauuggucugcauguuguauacaccucuuagggcuagugguaguucuucaggcacugacccauuugucauugcaggaaggguccugacuugcccgagcccagauuuuaguuucuuauuucuuguccccccgaauguagaacagaaaacuaagcccuuuucugugcccaacuugccacuaaauacacucucuaacucaaggguuccuucacucaucaaugcuaugaugauuucuagagaccaugggcagauggugcaguuccaaaauggcagagucacgcuugauggccaguugcaggguacaaccccuacuucacugagccagcuaugcaagauuagagggaaagucuuccaugccagugggggcaauggucugaaucugacugaauuagaugguucugcuuaucaugcuuuugaaaguccugcuccaauuggguuuccggacaucggugacugugacuggcacaugagcgccacagccacuaacaauuucacuggguccagcaaugaauaucaaauacucauuaaacaagaaucagcauuugcuccccaccuuggccaugugcaggcugauaaucugucagcaggcgccaacacugaucuuauaguguccuugaguuggauauccccuguuucagaccaacauaggcaugacguggauccaugggucauaccacguuaugguucuucccucacugaagcugcccaauuggccccgcccauuuacccuccuggcuuuggugaagcuauaguguucuuuaugucugacuuuccaguggugucagguguuaaugguaugaggauuccaugcacacuaccucaggaauauguggcucauuuuguaaacgagcaggcucccacucgaggugaagcagcucuuuugcauuauguugauccugacacucacagaaaccuaggugaguuuaaaauguauccugaggguuucaugaccugugugcccaauuccaguggaucugguccucaaaccuuaccuauuaauggagucuuuaccuuuguuucuuggguuucucguuucuaucaauuaaagccugugggaacugcugguccagcacguaggcuuuaa

SEQ ID NO: 7089 - RNA, 1620 nt, Artificial Sequence
  VP1__Norovirus_and/or_Norovirus-like__JN699049
augaugauggcgucuaaggacgccccaacaaacauggauggcaccaguggugccggccagcugguaccagaggcgaauacagcugagccuauaucaauggagcccguggcuggggcagcaacagcugccgcaaccgccggccaaguuaauaugauugaccccuggauuaugaauaauuaugugcaagccccucaaggcgaauucaccauaucaccaaauaauacaccuggugauauuuuauuugauuuacaacuaggcccccaccucaaucccuuucugucucauuuggcccaaauguauaauggcuggguagguaauaugaaaguaaaaguucuauuggcagguaacgcuuucacagcggggaaaauaaucauuagcugcauaccuccuggcuuugcuucacaaaauaucucuauagcucaagcuacaauguucccccauguuauagcugauguuagggucuuggagcccauugaggucccguuggaggauguaagaaauguguuauuccauaacaaugacaacacaccaaccaugaggcugguaugcaugcucuacacccccuugcgugccaguggaaguucaucugggacggaccccuuugugauagcugggcguguguugacuuguccuaguccagacuuuagcuuucuauuuuugguuccccccaauguagaacaaaagacuaaacccuuuagugucccaaaccucccacuuaauguucuuucaaacucaagggugccaucucuaauaaaauucaugauggugucacaggaccacgggcaaauggugcaauuccaaaauggcagagucacgcuggacggacagcuccagggcacuacaccaacaucggccagccaacucuguaagaugcgggggacggucuaucacgccuccgguggccaagggcucaacuugacugaaauugaugguacuccuuaucaugcauuugaaagcccagcccccauugguuucccugauuuaggagauagugauuggcacauuaaugcuucaccugccaccaccuucaacacuggugaaagugucaagaggcuggauauggaacaagguuccucauucgccccgcauuugggcacugugcauuauaccaaugcugacuaugacgccaacacugauuuaaucugcucauuggaauggcuguccccccccaguggggguaccccaaacaaagucaaucccugggccauaccacgguacgguucgaccuuaaccgaagccgcucaauuggccccaccaaucuaccccccuggcuuuggugaagcaauaguuuucuuuaugucugauuuuccuauagcaaauggucaagauggauuaaaaguacccugcacuauaccccaagaguuuguaacccauuuuguuaaugaacaagcaccaacccguggggaggcugcccuccuccauuauguugacccugacacacaccgcaauuugggugaguucaaauuauacccugaaggguucaugacuuguguaccaaacuccaguggcagcgguccccaaacguugcccauuaauggggucuucacuuuugucucuuggguuucccguuucuaucaauuaaagccugugggaacgaccggaccgguucguaggcuuuaa

SEQ ID NO: 7090 - RNA, 1620 nt, Artificial Sequence
  VP1__Norovirus_and/or_Norovirus-like__GQ856473
augaugauggcgucuaaggacgccccaacaaacauggauggcaccaguggugccggccagcugguaccagaggcaaauacagcugagccuauuucaauggaaccaguagcuggggcugcgacagcagccgcaacugcuggacaaguaaauaugauugaccccuggauaaugaauaauuauguacaagccccucaaggagaguucaccauuucgcccaacaacacuccuggugacauuuuauuugaccuacaauuggguccacaccucaacccuuucuugucccauuuagcucaaauguacaaugguugggucggaaacaugaaagugaaggugcuuuuggcaggcaaugccuuuacagcugggaagauuauaauuaguuguauacccccuggcuuugccgcacaaaauauuuccauagcucaagcuacaauguucccccaugucauugcagaugucagagugcuugaaccuauagagguuccccuugaagaugucagaaaugugcucuuccauaauaaugauaauuccccuacuaugagauuggucugcauguuauauacaccucuuagggcuagugguagcucaucagguacugacccauuugucauugcaggaaggguccugacuugcccgagcccggauuuuagcuucuuauuucuuguccccccgaauguagaacagaaaaccaaacccuucucugugcccaacuugccacuaaauacacucucuaacucaaggguuccuucacuuaucaaugcuaugaugauuucuagagaccaugggcagauggugcaguuccagaauggcagggucacgcuugauggucaguugcaggguacaaccccuacuucacugagccagcuauguaagauuagagggaaagucuuccaugcuaguggaggcaauggucugaaccucacugaauuggauggcucugcuuaucaugccuuugaaaguccugcuccaauuggguucccagacauuggugagugugauuggcacaugaacgccacagcuacuagcaauuucacuggguccaaugaugaguaucaaauucuugucaaacaagagucaacauuugccccccaccuuggucaugugcaggcugacagccuaucggcagacgcuaacaccgaccuuauggugucuuugaguuggauauccccuguuucagaccaacacaggcgugacguggacccaugggucauaccacguuaugguucuucccucacugaagcugcccaauuggccccgcccauuuacccuccuggauuuggugaagcuauaguguucuuuaugucugauuuuccaguggugucggguguuaaugguaugaggauuccaugcacacuaccucaggaauauguggcucauuuuguaaacgagcaggcucccacucgaggugaggcagcucuuuugcauuauguugauccugacacucacagaaaccuaggugaguuuaaaauguauccugagggcuuuaugaccugugugcccaauuccaguggaucugguccucagaccuuaccuauuaauggaguccuuacuuuugucucuuggguuucucguuucuaucaauuaaagccugugggaacugcugguccagcacguaggcuuuaa

SEQ ID NO: 7091 - RNA, 1620 nt, Artificial Sequence
  VP1__Norovirus_and/or_Norovirus-like__JN699050
augaugauggcgucuaaggacgccccaacaaacauggauggcaccaguggugccggccagcugguaccagaggcaaauacagcugagccuauaucaauggagcccguggcuggggcagcgacagcugccgcaaccgcuggccaaguuaauaugauugaccccuggauuaugaauaauuaugugcaagccccucaaggugaauucaccauaucaccaaacaauacaccaggugauauuuuauuugauuuacaacuaggcccccaccuuaauccauuucuaucucauuuggcccaaauguacaauggcugggugggcaauaugaaggugaaaguucuauuggcaggcaacgcuuucacagcaggaaaaauaaucauuagcugcauaccuccugguuuugcuucacaaaauaucuccauagcccaagccacaauguucccccacguuauagcugaugucaggguccuggagcccaucgagguuccguuggaggacguaaggaauguguuauuccacaacaaugacaauacaccaacuaugaggcugguaugcaugcucuacacccccuugcgcgccagcgggaguucaucugggacagaccccuuuguaauugcugggcgugugcugacuugcccuaguccagauuucagcuuuuuauuuuuaguuccccccaacguagaacaaaagacuaaaccuuuuaguguuccaaaucuuccacucaauguucuuucaaacucgagaguaccaucccuaauaaaauccaugauggugucacaggaccacggacaaauggugcaauuucaaaauggcagagucacgcuggacggacagcuccagggcacuacgccaaccucagccagccaacucugcaagaugcgggggacgguuuaucacgccucugguggccaagggcucaauuugacugaaauugauggcacucccuaccacgccuuugaaagcccagccccuauugguuucccugacauaggagacagcgauuggcacauuaaugcuucaccugccaccaccuuugacagcggugaaagcaucaaaaggcuagacauggaacagggcuccucauucgccccacauuuggguacugugcacuacacaaaugcugacuauccugccaauacugacuuaauuugcucauuggaauggcugucccccccuagugggggcaccccaaacaaagucaacccuuggaccaucccgcgguacgguucaaccuuaacugaagccgcccaauuggccccaccaauuuacccccccgguuuuggugaagcaauaguuuucuucaugucugauuucccuauagcaaauggucaagauggauugaaaguacccugcacuauaccccaggaauuuguaacccauuuugucaaugaacaagcaccaacccguggggaggcugcccuccuucauuauguugacccugauacacaucgcaacuugggugaguucaaauuauacccugaaggauuuaugacuugugugccaaacuccaguggcagcgguccccaaacgcugcccauuaauggggucuucacuuuugucucuuggguuucccguuucuaucaauuaaagccugugggaacgaccggaccgguucguaggcucuaa

SEQ ID NO: 7092 - RNA, 1620 nt, Artificial Sequence
  VP1__Norovirus_and/or_Norovirus-like__GQ856472
augaugauggcgucuaaggacgccccaacaaacauggauggcaccaguggugccggucagcugguaccagaggcaaauacagcugaaccuauaucaauggacccaguggcuggagccgcaacagcgguugcaacugcuggacaaauuaauaugauugaccccuggauaaugaguaauuuugugcaagccccacaaggggaauucacugucucaccuaacaacaccccuggagauguucuguuugauuuacaauugggaccucaacuaaauccauuccucgcucaucuagcccagauguauaauggcuggguaggcaauaugcgugugaaggugcugcuugcuggcaacgcuuuuacugcagggaaaauaauaauuagcugcauacccccagguuuuaccucccaaaauauuucuauugcccaaaugacaauguuuccucauguuaucgcugacgugaggguuuuggaaccuauagaaauaccccuugaggaugugaggaaugugcuguuucacaccaaugacaaccgcccaacaaugaggcuugugugcauguuguauacucccuugcgagccaauggcaguucuucuggcacggacccuuuugucauagcuggccggguucucaccugcccagauucaaauuuuaguuuccuauuuuuaguacccccuaauguagaacaaaagacuagaccuuuuaguguucccaauauaccucugaauacauugucaaauucaagggugccaucauugauuaagucuaugaccaucucuagagaucagaaucaaauaauucaauuucaaaaugguaggguuacauuggauggucagcuacagggcaccacacccacaucagugagccaguuguguaaaauuagaggcacuacauaccacgcaacuggagguagugggauaaauuuaacagaguugaauggugaaccauaccaugccuuugaaagccccgccccgauaggguuuccagaucuuggugguugcgauuggcaucucacagcaacccccacgcaggcuuucaacgauggagcaaagguugugcgccugucagucacccagggcgcagccuuugcaccacacuuggguaccauacauuacaccacuacugacacugauuacaaccccaacacuagcauaauuugcacacuagauuggcugucccaaacuacuggucagaguaauguugacccuuggcagauaccaacuuaugggucggcuuuaacugaagccgcucaguuggcgccuccuaucuuucccccuggguuuggagaaacauugguuuucuuucuaucagacuucccuauuuccaauggcaagaacggacucaguguaccgugcacucuuccacaggaauuugucacccauuuugugaaugaacaggccccaaucagaggagaggccgcccucuugcauuauguugacccugacacucaccguaaucuuggagaguuuaaauuguauccagaagguuuuaugaccuguguuccuaauacuagugguggugguccccaaacuuugccuaucaauggagucuuugucuuuguuucuugggucucucgcuuuuaccaguugaagccugugggaacggccggugcggcucguaggcuuuaa

SEQ ID NO: 7093 - RNA, 1620 nt, Artificial Sequence
  VP1__Norovirus_and/or_Norovirus-like__GQ856471
augaugauggcgucuaaggacgccccaacaaacauggauggcaccaguggugccggucagcugguaccagaggcaaauacagcugaaccuauaucaauggacccaguggcuggagccgcaacagcgguugcaacugcuggacaaauuaauaugauugaccccuggauaaugaguaauuuugugcaagccccacaaggggaauucacugucucaccuaacaacaccccuggagauguucuguuugauuuacaauugggaccucaacuaaauccauuccucgcucaucuagcccagauguauaauggcuggguaggcaauaugcgugugaaggugcugcuugcuggcaacgcuuuuacugcagggaaaauaauaauuagcugcauacccccagguuuuaccucccaaaauauuucuauugcccaaaugacaauguuuccucauguuaucgcugacgugaggguuuuggaaccuauagaaauaccccuugaggaugugaggaaugugcuguuucacaccaaugacaaccgcccaacaaugaggcuugugugcauguuguauacucccuugcgagccaauggcaguucuucuggcacggacccuuuugucauagcuggccggguucucaccugcccagauucaaauuuuaguuuccuauuuuuaguacccccuaauguagaacaaaagaccagaccuuuuaguguucccaauauaccucugaauacauugucaaauucaagggugccaucauugauuaagucuaugaccaucucuagagaucagaaucaaauaauucaauuucaaaaugguaggguuacauuggauggucagcuacagggcaccacacccacaucagugagccaguuguguaaaauuagaggcacuacauaccacgcaacuggagguagugggauaaauuuaacagaguugaauggugaaccauaccaugccuuugaaagccccgccccgauaggguuuccagaucuuggugguugcgauuggcaucucacagcaacccccacgcaggcuuucaacgauggagcaaagguugugcgccugucagucacccagggcgcagccuuugcaccacacuuggguaccauacauuacaccacuacugacacugauuacaaccccaacacuagcauaauuugcacacuagauuggcugucccaaacuacuggucagaguaauguugacccuuggcagauaccaacuuaugggucgacuuuaacugaagccgcucaguuggcgccuccuaucuuucccccuggguuuggagaaacauugguuuucuuucuaucagacuucccuauuuccaauggcaagaacggacucaguguaccgugcacucucccacaggaauuugucacccauuuugugaaugaacaggccccaaucagaggagaggccgcccucuugcauuaugcugacccugacacucaccguaaucuuggagaguuuaaauuguauccagaagguuuuaugaccuguguuccuaauacuagugguggugguccccaaacuuugccuaucaauggagucuuugucuuuguuucuugggucucucgcuuuuaccaguugaagccugugggaacggccggugcggcucguaggcuuuaa

SEQ ID NO: 7094 - RNA, 1620 nt, Artificial Sequence
  VP1__Norovirus_and/or_Norovirus-like__JQ911594
augaugauggcgucuaaggacgccccaacaaacauggauggcaccaguggugccggucagcugguaccagaggcaaauacagcugaaccuauaucaauggacccaguggcuggagccgcaacagcgguugcaacugcuggacaaauuaauaugauugaccccuggauaaugaguaauuuugugcaagccccacaaggggaauucacugucucaccuaauaacaccccuggagauguucuguuugauuuacaauuggggccucaacuaaauccauuccucgcccaucuagcccagauguauaauggcuggguaggcaauaugcgugugaaggugcugcuugcuggcaacgcuuuuacugcagggaaaauaauaauuagcugcauacccccagguuuuaccucccaaaauauuucuauugcccaaaugacaauguuuccucaugucaucgcugacgugaggguucuggaaccuauagaaauaccccuugaggaugugaggaaugugcuguuucacaccaaugacaaccgcccaacaaugaggcuuguaugcauguuguauacccccuugcgagccaauggcaguucuucuggcacggacccuuuugucauagcuggucggguucucaccugcccagauucaaauuucaguuuccuauuuuuaguacccccuaauguagaacaaaagacuagaccuuuuaguguucccaauauaccucugaauacauugucaaauucaaggguaccaucauugaucaagucuaugaccaucucuagagaucagaaucaaauaauucaauuccaaaauggcagggucacauuggauggucaguuacagggcaccacacccacaucagugagccaguuguguaaaauuagaggcacuacauaccacgcaacuggagguaaugggauaaauuuaacagaguugaauggugagccauaccaugccuuugaaagccccgccccgauaggguuuccagaccuuggugguugcgauuggcaucucacagcaacccccacgcaggcuuucaaugauggagcgaaggucgugcgccugucagucacccagggcgcagccuuugcaccacaccuggguaccauacauuacaccacuacugauacugauuacaaccccaacacuagcauaauuugcacacuagauuggcugucccaaacugcuggucagaguaauguugacccuuggcagauaccaacuuaugggucgacuuuaacugaagccgcucaguuggcgccucccaucuuucccccuggguuuggagaaacauugguuuucuuucuaucagacuuuccuauuuccaauggcaagaacggacucaguguaccgugcacucucccacaggaauuugucacccauuuugugaaugaacaggccccaaucagaggagaggccgcccucuuacauuauguugauccugacacucaucguaaucuuggagaguuuaaauuguauccagaagguuuuaugacuuguguuccuaauacuagugguggugguccccaaacuuugccuaucaauggagucuuugucuuuguuucuugggucucucgcuuuuaccaguugaagccugugggaacagccggugcggcucguaggcuuuaa

SEQ ID NO: 7095 - RNA, 1620 nt, Artificial Sequence
  VP1__Norovirus_and/or_Norovirus-like__GU296356
augaugauggcgucuaaggacgcuaccucaaacauggauggcaccagcggagcuggacaacuggugccagagaauaauaacaccucagaaccaaucaauauggaaccaguugcgggcgcgguuacugccgcagccacggcuggccaggugaauaugauugauccuuggauaaugaauaauuaugugcaagccccccagggugaauuuacaaucucacccaauaauaccccuggugacauauuguuugaucuucaauuggguccccaccugaauccuuuucuugcucacuuaucccagauguauaauggauggguugguaacaugaaggucaggguggugcuggcuggcaaugccuuuucugcgggaaagaucauagugugcuguauaccaccuggauuuucugcaccaaacauauccauagcccaggcaacuauguucccgcauguuauugcugauguucggguuuuggagcccauugauauuccccuugaugaugucaggaauguuuuguuucauacuaaugauaaugguaaucagaccaugagauugcugugcauguuguauacaccacuucguaguggagguacauccaguggaacugauccauuugugauugcugguaggguuuuaaccuguccuacuccagauuuuaauuucuuguuuuuaguucccccaaccguugagcaaaagaccaaacaguuuagugugccaaaccuuccccucaauguuaugucuaacucuagaguuccaucacugcugaaugcuaugguggugucaccagaucaggcucaaguggugcaguuccagaauggcaggugcacccuugaugggcaaauguuaggcaccacuacugugucagcuaguuguguugcaagauucagagggaaaacuuuucaagccccugacgacagguuaggcauuaaucuggcugaaauuaguggagaaccauaucaugcauuugaaagccccgccccccuagguuucccugauuuuggggauggagauuggcacgucacugcaacaaaaguagcccccucacagcucgaagcuaaugauccuguggucguggggaauguccaaccauauaacccacaguuugcuccucaccugggcacccuaguuguagaaaaccccaccccaaaucaaguggccaccgggacugaccuauuauucaacauaaccuggcuuuccaaucgugccaauaaucgguuuaacccuuggaucauuccaaauuaugguucaacucucacggaggcagcacagcuagcaccuucaauauuucccccuggcuuuggugaaacuauaguguacuucaauuccacuuuuccagcugugggagccaccacccaugcagcuauacccugucugcuuccacaagaauuuguugcucauuuuguuaaugagcaggcccccauacguggagaggcugcuuugcuccauuacauugacccugacacucaccguaaucuuggugaguucaaaauuuauccugagggcuuugugacgugugucccuaauguggguggcacagggccgcaaucucuaccuacuaaugguaucuuugucuuuguuucuugggugucaagguacuaucaacucaagccugugggaacugccuaa

SEQ ID NO: 7096 - RNA, 1620 nt, Artificial Sequence
  VP1__Norovirus_and/or_Norovirus-like__KM461693
augaagauggcgucgaaugacgccgcuccaucaaaugauggugcugccaaccucguaccagaggccaauaaugagguuauggcacuugaaccgguggugggagcuucaaucgcagcuccuguugucggucagcagaauauaauugaccccuggauuagagaaaauuuuguucaagcaccacagggcgaguuuacuguuucaccaaggaacucgcccggugagaugcuuuuaaaucuugaauugggcccagaacuuaaccccuauuugagucauuugucccgcauguacaauggguaugcugguggcaugcagguucaggugguccuagcugggaaugcguucacagcugggaagaucaucuuugccgcugugccaccacacuucccuguggauaauauuagugcagcccagauaacuauguguccccaugugauuguugaugugagacagcuugaaccagugcuucuaccccuccccgauauaaggaacagguucuuccauuacaaccaggaagacaccccccggaugaggcuuguggccaugcucuacacaccucuaagggcuaauuccggagaggauguguucacuguguccuguaggguucugacucgccccgcuccagauuuugaauuuacauucuuaguuccaccaacuguugaaucaaaaacaaaacccuuuacucuaccuauccuaacccuuggugagcugucuaauucccguuuuccugcugccauagauaugcuuuacacugaucccaaugaaucaauaguuguucagccccaaaaugguagauguacccuugacggcacgcugcaaggcacaacacaauuggucccaacacagauuugugccuuuagagguacucugaucagucagaaugcgagagcggccgauuuaacagauuccccccagagagcccguaaucacccguugcacguccaggucaagaaccuagauggcacacaguaugacccaacagaugacaucccugcaguccugggggcuauugacuucaaagguacaguguucggaguggcaagucagagggacgucucuggaacacaagaacagggccauuaugccacccgggcucaugaagcacacauugacacaacugauccaaaguaugcaccuaaauuaggcacaauucucaucaaaucugaaucuacugauuucaccacaaaucagcccauuagguucacuccagugggcaugggcgacaacaauuggagacagugggaauugccugacuauucugguaguuugacucuaaauaugaaccuugccccugcuguuuccccaucuuucccuggugaacgaauccuuuucuuuaggucuauaguaccaucagcuggaggcuacgggucuggcuauauagacugucucauaccccaggaaugggugcaacauuucuaccaggaggcagcaccuucacaauccgcuguugcacugguuagguaugucaaccccgacacugggcguaacaucuuugaggccaaguugcacagagaaggguuccucaccguggcuaauucuggaaacaauccuauggggguucccccuaaugguuauuuuagauuugaggcuuggguuaaucaauucuacacacucgccccauaa

SEQ ID NO: 7097 - RNA, 1620 nt, Artificial Sequence
  VP1__Norovirus_and/or_Norovirus-like__LC145789
augaagauggcgucgaaugacgccgcuccaucuacugauggugcagccggccucgugccagaaaguaauaaugaggucauggcucuugaacccguggcuggugccgccuuggcagccccagucaccggucaaacaaauauaauagacccuuggauuagagcaaauuuuguccaggcccccaauggugaauuuacagucucuccccguaacuccccuggugaagugcuauugaaucuagaguuggguccagaauuaaauccuuaucuggcacauuuagcaagaauguauaauggguaugccggugggauggaggugcaggucauguuggcugggaacgcguucacagccggcaaguuagucuucgccgcugugccaccccacuucccggucgaaaaccuuagcccacagcaaauuaccauguucccucaugugauuauagaugucaggacuuuggaaccuguuuuauuaccacucccugauguuagaaacaacuucuuccauuacaaucagaaagaugaucccaagaugagaauuguggcuaugcuuuauaccccccuuaggucuaaugguucaggcgaugauguguuuacagucuccugcaggguguugacuagacccuccccugauuuugauuucacauaucuggugccaccaacaguggaaucuaaaacaaaaccauucacucucccaauccucacgcuuggggaacuuuccaauucuagguucccaguguccauagaucagauguacaccagccccaaugaagucauaucagugcagugucaaaauggcaggugcacacuggauggggaacuccaaggaacaacacaacuccaagucaguggcauuugugcuuucaagggagaagugacugcccacuugcaugacaaugaucaccuguauaaugucaccaucacaaacuugaauggguccccuuuugaccccuccgaggacauccccgccccucugggcguaccugacuuucagggaagggucuuuggugucaucucccaaagagacaaacacaauaccccuggacauaaugaaccagcaaacagggcacacgaugccguggucccuacuuauacagcacaguauaccccaaaauugggucagauucaaauuggcacauggcagacugacgaucucacagucaaccaaccagucaaauucaccccaguuggacuuaaugacacugaccauuuuaaccaaugggugguccccagguaugcuggugcccuaaaccuuaauacaaaccuugccccuucuguugcuccaguauuuccaggggagcgucugcucuuuuucagaucauacaucccccucaaggguggcuauggaacuccagccaucgauugccuacuaccacaagagugggugcaacauuucuaucaggaagcagccccuucgaugagugagguggcccuugucagauacaucaacccggauacuggucgggcacuguuugaggccaaacuccacagagcugguuucaugacagucucaagcaacaccagugccccggugguugugccugccaacggauacuucagguuugauucuugggugaaccaauucuauucucucgcccccaugggaacuggaaaugggcgcagauaa

SEQ ID NO: 7098 - RNA, 1617 nt, Artificial Sequence
  VP1__Norovirus_and/or_Norovirus-like__KX171417
augaagauggcgucgaaugacgccgcuccaucuaaugauggugcugcuggucucguaccagagggcaacaacgagacccuuucccuagaaccaguugcgggcgcagcuauagccgcacccgucacuggccaaaacaacauaauugaccccuggauuagaacaaacuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaguucuuaagcccagcccagauuacaaugcucccacauuuaauaguagaugucaggacucuugaaccaauuaugaucccacucccugauguuaggaauacauucuuccauuauaacaaccagccuaacagccgcaugagauuaguggcuaugcucuacaccccccuuagaucuaauggcucaggugaugaugucuuuacugucucuuguaggguuuugacuaggccuacuccugauuuugaguucacuuauuuagugccaccuucuguugaaucuaagacuaagccuuuuuccuuaccuauucuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcaaaaacugaccauagugacaaguggcacaugcaacugcaaaaccucaauggcacaacauaugacccaacugaugaugugccagcuccgcuggguacaccugacuucaagggcgucguguuugggguagcaagccaaagaaauguggguaaugaugcgccuggcucaaccagggcccaugaggcggugauuucaaccuauagcccccaauuuguccccaaauuagguucugucaauuuuagaaguaaugaugaugauuuccaauugcagccgacaaaauucacaccagugugcaucaaugacgaugaugaccacccguucagacagugggaacuaccagacuauucagggcugcuuaccuugaauaugaaccuugcccccccgguugcuccaaauuucccuggugaacaauuauuauucuucagaucuuuugugccaugcucaggagguuauaaccaaggcauuguagauugucuuauuccccaagaauggauccaacacuucuaucaggaaucagcgcccucccagucagaaguggcccuaaucagguauguuaaccccgauacgggacguacacuguuugaagcaaaauugcacagaucugguuacaucacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 7099 - RNA, 1617 nt, Artificial Sequence
  VP1__Norovirus_and/or_Norovirus-like__KX171412
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucaucugucaaggauguacaauggguaugcugguggaguggaaguucagguucuccuggcagggaacgcguucacugccggaaagauccucuucgccgccgucccgccaaauuucccaguggaauucuuaagcccagcccagauuacaaugcucccacauuuaauaguagaugucaggacucuugaaccaauuaugaucccacucccugauguuaggaauacauucuuccauuauaacaaccagccuaacagccgcaugagauuaguggcuaugcucuacaccccccucagaucuaauggcucaggugaugaugucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucagaauggcaggugcacacuugauggugaguuacaaggcacaacccaguugcucccaucuggcaucugcgcauucagaggacgggugacagcagaaacugaccaucaugacaaguggcacaugcaacugcaaaaccucaauggcacaacauaugacccaacugaugaugugccagccccgcuggguacaccugacuucaagggcgucguguuugggguagcaagccaaagaaauguggguaaugaugcgccuggcucaaccagggcccaugaggcggugauuucaaccuauagcccccaauuuguccccaaauuagguucugucaauuuuagaaguaaugaugaugauuuccaauugcagccgacaaaauucacaccagugggcaucaaugacgauggugaccacccguucagacagugggaacuaccagacuauucagggcugcuuaccuugaauaugaaccuugcccccccgguugcuccaaauuucccuggugaacaauuauuauucuucagaucuuuugugccaugcucaggagguuauaaccaaggcauuguagauugucuuauuccccaagaauggauccaacacuucuaucaggaaucagcgcccucccagucagacguggcccuaaucagguauguuaaccccgacacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 7100 - RNA, 1617 nt, Artificial Sequence
  VP1__Norovirus_and/or_Norovirus-like__KU557839
augaagauggcgucgaaugacgccgcuccaucuagugauggugcugcuggucuuguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagauuacaaugcucccacauuuaauaguagaugucaggacucuugaaccaauuaugaucccacucccugauguuaggaauacauucuuccauuauaacaaccagccuaacagccgcaugagauuaguggcuaugcucuacaccccccuuagaucuaauggcucaggugaugaugucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaauggcacaacauaugacccaacugaugaugugccagccccgcuggguacaccugacuucaagggcgucguguuugggguagcaagccaaagaaauguggguaaugaugcgccuggcucaaccagggcccaugaggcggugauuucaaccuauagcccccaauuuguucccaaauuagguucugucaauuuuagaaguaaugauaaugauuuccaauugcagccgacaaaauucacaccagugggcaucaaugacgauggugaccacccguucagacagugggaacuaccagacuauucagggcugcuuaccuugaauaugaaccuugcccccccgguugcuccaaauuucccuggugaacaauuauuauucuucagaucuuuugugccaugcucaggagguuauaaccaaggcauuguagacugucuuauuccccaagaauggauccaacacuucuaucaggaaucagcgcccucccagucagacguggcccuaaucagguacguuaaccccgauacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 7101 - RNA, 1617 nt, Artificial Sequence
  VP1__Norovirus_and/or_Norovirus-like__KP902564
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagauuacaaugcucccacauuuaauaguagaugucaggacucuugaaccaauuaugaucccacucccugauguuaggaauacauucuuccauuauaacaaccagccuaacagccgcaugagauuaguggcuaugcucuacaccccccuuagaucuaauggcucaggugaugaugucuuuacugucucuugcaggguuuugacuaggccuacuccugauuuugaguucacuuacuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaauggcacaacauaugacccaacugaugaugugccagccccgcuggguacaccugacuucaagggcgucguguuugggguagcaagccaaagaaauguggguaaugaugcgccugacucaaccagggcccaugaggcggugauuucaaccuauagcccccaauuuguccccaaauuagguucugucaauuuuagaaguaaugauaaugauuuccaauugcagccgacaaaauucacaccagugggcaucaaugacgauggugaccacccguucagacagugggaacuaccagacuauucagggcugcuuaccuugaauaugaaccuugcccccccgguugcuccaaauuucccuggugaacaauuauuauucuucagaucuuuugugccaugcucaggagguuauaaccaaggcauuguagauugucuuauuccccaagaauggauccaacacuucuaucaggaaucagcgcccucccagucagacguggcccuaaucagguauguuaaccccgauacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 7102 - RNA, 1617 nt, Artificial Sequence
  VP1__Norovirus_and/or_Norovirus-like__KU587625
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccgggaagauccucuucgccgccgucccgccaaauuucccaguggaauuccuaagcccagcccagaucacaaugcucccacauauaauaguagauguuaggacucuugaaccaauuaugaucccauuaccugauguuaggaauacauucuuccauuauaacaaccagcccaacagccgcaugagauugguggcuaugcucuauaccccccuuagaucuaauggcucaggugaugauguuuuuacuguuucuugcaggguuuugacuaggcccacuccugauuuugaguucacuuauuuagugccaccuucuguugaaucuaagacuaagccuuuuuccuuacccauucuaacccuuucugagcucacaaauucgagguucccaguccccaucgauucgcuuuucaccgcccagaauaauguguugcagguacagugucaaaauggcaggugcacacuugauggugaguuacaaggcacaacccaguugcucccaucuggcaucugugcauucagaggacgggugacagcagaaacugacaauccugacaaguggcacaugcaacugcaaaaccucaauggcacaacauaugacccaacugaugacgugccagccccacuggguacaccugacuucaagggcgucguguuugggguggcaagccaaagaaauguggguaacgaugcgccuggcucaaccagggcccaugaggcggugauuucgaccuauagccccaaauuuguccccaaauuaggcucugucaauuuuagaaguaaugaugaugauuuccaauugcagccgacaagauucacaccagugggcaucaaugacgaugguaaccacccguucagacaaugggaacuaccagacuauucaggggugcuuaccuugaauaugaaccuugcccccccgguugcuccaaauuucccuggugaacaauuauuacucuucagaucuuucgugccauguucaggagguuauaaccaaggcauuauagauugucuuauuccccaagaauggauccaacauuucuaucaggaaucagcacccucccagucagacguggcccugaucagguaugucaaccccgacacgggacgcacacuguuugaagcaaaauugcauagaucuggcuauaucacuguggcucauucuggagauuauccucuuguuguuccggcuaauggauacuuuagauuugauucuuggguaaaccaguuuuacucacucgccccaaugggaacugggaaugggcgaaggagggcucaguaa

SEQ ID NO: 7103 - RNA, 1617 nt, Artificial Sequence
  VP1__Norovirus_and/or_Norovirus-like__KX171413
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagauuacaaugcucccacauuuaauaguagaugucaggacucuugaaccaauuaugaucccacuccccgauguuaggaauacauucuuccauuauaacaaccagccuaacagccgcaugagauuaguggcuaugcucuacaccccucuuagaucuaauggcucaggugaugaugucuuuacugucucuugcagaguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacggguaacaacagaaacugaccaucgugacaaguggcacaugcaacugcaaaaccucaauggcacaacauaugacccaacugaugaugugccagccccguuggguacaccugacuucaagggcgucguguuugggguagcaagccaaagaaauguggguaaugaugcgccuggcucaaccagggcccaugaggcggugauuucaaccuauagcccccaauuuguccccaaauuagguucugucaauuuuagaaguaaugaugaugauuuccaauugcagccgacaaaauucacaccaguggguaucaaugacgauggugaccacccguucagacaaugggaacuaccagauuauucagggccgcuuaccuugaauaugaaccuugcccccccgguugcuccaaauuucccuggugaacaauuauuauucuucagaucuuuugugccaugcucaggagguuauaaccaaggcauuguagauugucuuauuccccaagaauggauccaacacuucuaucaggaaucagcgcccucccagucagacguggcccuaaucagguauguuaaccccgauacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 7104 - RNA, 1617 nt, Artificial Sequence
  VP1__Norovirus_and/or_Norovirus-like__KP902565
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagaugucaggacucuugaaccaauuaugaucccacucccugauguuaggaacacauucuuccauuauaacaaccagccuaacaaccgcaugagauuaguggcuaugcucuacacuccccuuagaucuaauggcucaggugaugaugucuuuacugucucuugcaggguuuugacuaggccuacuccugauuuugaguucacuuauuuagugccaccuucuguugaaucuaagacuaagccuuuuucuuuaccuauuuuaacccuuucugagcucacaaauucgagguucccaguucccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaauggcacaacauaugacccaacugaugaugugccagccccgcuggguacaccugauuucaagggcgucguguuugggguagcaagccaaagaaauguggguaaugacgcgccuggcucaaccagggcccaugaggcggugauuucaaccuacagcccccaauuuguccccaaauuagguucugucaauuuuagaaguaaugauaaugauuuccaauugcagccgacaaaauucacaccagugggcaucaaugacgauggugaccacccguucagacagugggaacuaccagauuacucagggcugcuuaccuugaauaugaaccuugcccccccgguugcuccaaauuucccuggugaacaauuauuauucuucagaucuuuugugccaugcucaggagguuacaaccaaggcauuguagauugucuuauuccccaagaauggauccaacacuucuaucaggaaucagcgcccucccagucagacguggcccuaaucagguauguuaaccccgauacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 7105 - RNA, 1617 nt, Artificial Sequence
  VP1__Norovirus_and/or_Norovirus-like__KX171416
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuuuccaguggaauucuuaagcccagcccagaucacaaugcucccacauuuaauaguagaugucaggacucuugaaccaauuaugaucccacucccugauguuaggaacacauucuuccauuauaacaaccagccuaacaaccgcaugagauuaguggcuaugcucuacacuccccuuagaucuaauggcucaggugaugaugucuuuacugucucuugcaggguuuugacuaggccuacuccugauuuugaguucacuuauuuagugccaccuucuguugaaucuaagacuaagccuuuuucuuuaccuauuuuaacccuuucugagcucacaaauucgagguucccaguucccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaauggcacaacauaugacccaacugaugaugugccagccccgcugggcacaccugauuucaagggcgucguguuugggauagcaagccaaagaaauguggguaaugacgcgccuggcucaaccagggcccaugaggcggugauuucaaccuacagcccccaauuuguccccaaauuagguucugucaauuuuagaaguaaugauaaugauuuccaauugcagccgacaaaauucacaccagugggcaucaaugacgauggugaccacccguucagacagugggaacuaccagauuacucagggcugcuuaccuugaauaugaaccuugcccccccgguugcuccaaauuucccuggugaacaauuauuauucuucagaucuuuugugccaugcucaggagguuacaaccaaggcauuguagauugucuuauuccccaagaauggauccaacacuucuaucaggaaucagcgcccucccagucagacguggcccuaaucagguauguuaaccccgauacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 7106 - RNA, 1617 nt, Artificial Sequence
  VP1__Norovirus_and/or_Norovirus-like__KU561250
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggagaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccguuccgccaaauuucccaguggaauucuuaagcccagcccagauuacaaugcucccacauuuaauaguagaugucaggacucuugaaccaauuaugaucccacucccugauguuaggaauacauucuuccauuauaacaaccaaccuaacagccgcaugagauuaguggcuaugcucuacaccccccuuagaucuaauggcucaggugaugaugucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcaggugcacacuugauggugaguuacaaggcacaacccaguugcucccaucuggcaucugugcauucagaggacgggugacagcagaaacugaccaucgugacaaguggcacaugcaacugcaaaaccucaauggcacaacauaugacccaacugaugaugugccagccccgcuggguacaccugacuucaagggcgucguguuugggguagcaagccaaagaaauguggguaaugaugcgccuggcucaaccagggcccaugaggcggcgauuucaaccuauagcccccaauuuguccccaaauuagguucugucaauuuuagaaguaaugauaaugauuuccaauugcagccgacaaaauucacaccagugggcaucaaugacgauggugaccacccguucagacagugggaacuaccagacuauucagggcugcuuaccuugaauaugaaccuugcccccccgguugcuccaaauuucccuggugaacaauuauuauucuucagaucuuuugugccaugcucaggagguuauaaccaaggcauuguagauugucuuauuccccaagaauggauccaacacuucuaucaggaaucagcgcccucccagucagacguggcccuaaucagguauguuaaccccgauacgggacguacacuguuugaagcaaaauugcacagaucugguuacauuacuguggcucacucuggagacuauccucuuguuguuccggcuaauggauacuuuagauuugauucuuggguaaaucaguuuuacucacucgccccaaugggaacugggaaugggcgaaggagggcucaguaa

SEQ ID NO: 7107 - RNA, 1617 nt, Artificial Sequence
  VP1__Norovirus_and/or_Norovirus-like__KU561251
augaagauggcgucgaaugacgccgcuccaucuaaugauggugcugcuggucucguaccagagggcaacaacgagacccuuccccuagaaccaguugcgggcgcagcuauagccgcacccgucacuggccaaaacaacauaauugaccccuggauuagaacaaauuuugugcaagcaccaaauggggaguucacagugucacccagaaacuccccuggagaaauuuuacuaaaccuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagauuacaaugcucccacauuuaauaguagaugucaggacucuugaaccaauuaugaucccacucccugauguuaggaauacauucuuccauuauaacaaccagccuaacagccgcaugagauuaguggcuaugcucuacaccccccuuagaucuaauggcucaggugaugaugucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccacaauaauguguugcaggugcagugucaaaacggcaggugcacacuugauggugaguuacaaggcacaacccaguugcucccaucuggcaucugugcauucagaggacgggugacagcagaaacugaccaucgagacaaguggcacaugcaacugcaaaaccucaauggcacaacauaugacccaacugaugaugugccagccccgcuggguacaccugacuucaagggcgucguguuugggguagcaagccaaagaaauguggguaaugaugcgccuggcucaaccagggcccaugaggcggugauuucaaccuauagcccccaauuugucccuaaauuagguucugucaauuuuagaaguaaugauaaugauuuccaauugcagccgacaaaauucacaccagugggcaucaaugacgauggugaccacccguucagacagugggaacuaccagacuauucagggcugcuuaccuugaauaugaaccucgcccccccgguugcuccaaauuucccuggugaacaauuauuauucuucagaucuuuugugccaugcucaggagguuauaaccaaggcauuguagauugucuuauuccccaagaauggauccaacacuucuaucaggaaucagcgcccucccagucagacguggcccuaaucagguauguuaaccccgauacgggacguacacuguuugaagcaaaauugcacagaucugguuacauuacuguggcucacucuggagacuauccucuuguuguuccggcuaauggauauuucagauuugauucuuggguaaaucaguuuuacucacucgccccaaugggaacugggaaugggcgaaggacggcucaguaa

SEQ ID NO: 7108 - RNA, 1617 nt, Artificial Sequence
  VP1__Norovirus_and/or_Norovirus-like__AB810014
augaagauggcgucgaaugacgccgcuccaucgaaugauggugcagcuagucucguaccagaggccauuaaugagacuaugccauuggaacccguugcuggcgcaucuauugcugccccaguggcgggacaaaccaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgauuucccaucccaauugagcaacuguacacggccccgaaugagaauaaugucguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaaguaccagcacccuugggcacccaggacuucagagggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaauguacaccccaaucaacaaucacgguucacccccgucggagucgcucagaaugaaaacacccccuuucagcaauggguucuaccacacuacgcaggcgcucucgcucuaaacaccaauuuggcacccgcuguugccccgacuuucccuggcgagcaauuacuguucuucaggucccguguuccauguguccaaggccugcgggggcaggaugcuuucauagauugucuccuaccucaagagugggugaaucacuuuuaucaagaggcugcucccucccaagcagacguugcccuuaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgcccccaugggaacuggcaaugggcguuaa

SEQ ID NO: 7109 - RNA, 1617 nt, Artificial Sequence
  VP1__Norovirus_and/or_Norovirus-like__AB809985
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaagugccagcacccuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgcccccaugggaacuggcaaugggcguuaa

SEQ ID NO: 7110 - RNA, 1617 nt, Artificial Sequence
  VP1__Norovirus_and/or_Norovirus-like__AB810003
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcucccccauuugaucguagauguuaggacauuggaaccuauuaugauacccuuaccugauguuaggaauguguucuaucauuuuaauaaucaaccccaaccuaggaugagauuaguggcuaugcucuauaccccauugagauccaaugguucaggagaugaugucuuuacugugucuuguagaguguugacuaggccaaccccugacuuugaauucauuuaccuaguuccucccucuguagaguccaaaacuaaaccauucacacuuccaauauugaccauuucugaacuaaccaacucccgguuccccaucccaauugagcaacuguacacggccccaaaugagaauaauguuguacagugucaaaauggaaggugcaccuuggauggagagcuucagggcaccacccagcuacuaucaagugcagucugcucuuacaggggcaggacuguggcuaacagaggggacaauugggaccagaauuugcuccagcugaccuacccaaguggugcaagcuaugaccccacugaugaagugccagcaccuuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggaguugcucagaaugaaaacacccccuuccagcaauggguucuaccacacuacgcaggugcucucgcucuaaacaccaauuuggcacccgcuguugccccgacuuucccuggcgagcaauuacuguucuucaggucucguguuccauguguucaaggccugcgcgggcaggaugcuuucauagauugucuccuaccucaagagugggugaaucauuuuuaucaagaggcugcucccucccaagcagacguugcccucaucagguaugucaacccugauacuggucgcacgcuguuugaggccaaauugcauaggucagguuuuauuacuguaucacacacuggugccuacccucuugugguccccccaaauggucauuucagguuugauucuugguuuaaucaauucuacucacucgcccccaugggaacuggcaaugggcguuaa

SEQ ID NO: 7111 - RNA, 1617 nt, Artificial Sequence
  VP1__Norovirus_and/or_Norovirus-like__AB809975
augaagauggcgucgaaugacgccgcuccaucaaaugauggugcagcuagucucguaccagaggccauuaaugagacuaugccacuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauuuuauuaaauuuagaguuaggaccggauuuaaauccuuauuuggcccacuuaucaagaauguacaaugguuaugcuggagguguugaggugcaagugcuccuugcugggaacgcguucacagcaggcaagauacuauuugcagcaaucccacccaacuuuccuguagauaugauuagcccagcucaaaucacuaugcuuccccacuugauuguagauguuaggacuuuggagccuaucaugauacccuuaccugauguuaggaauguguucuaucauuuuaacaaucaaccucaaccuaggaugagauuaguggcuaugcucuauaccccauugagaucuaaugguucaggagaugaugucuuuacugugucuuguagagugcugacuaggccaaccccugacuuugaauucauuuaccuagugccccccucuguggaguccaagacuaaaccauucacacuuccaauauugaccauuucugagcuaaccaacucccgguuccccaucccaauugagcaacuguacacggccccaaaugagaauaauguuguacagugucaaaauggcaggugcaccuuggauggagagcuucagggcaccacccagcugcuaucaagugcaguuugcucuuacaggggaaggacuguggccaacaguggagacaauugggaccagaacuugcuccagcuguccuacccaaguggugcaagcuaugaccccacugacgaaguaccagcacccuugggcacccaggauuucagugggauauuguaugggguguuaacccaagacaauguuagugagagaacaggggaggccaaaaaugcuaagggaauauacauaucuaccaccaguggaaaauucaccccaaaaauugguucaauaggauugcauucaauaacugaaaaugugcaucccaaucaacaaucacgguucacccccguuggagucgcucagaaugagaacacccccuuccagcaauggguucuaccacacuacgcaggugcucucgcucuaaacaccaauuuggcacccgcuguugccccgacuuucccuggugagcaauuacuguucuucaggucccguguuccauguguucaaggccugcaggggcaggaugcuuucauagauugucuccugccucaagagugggugaaucauuuuuaucaagaggcugcuccuucccaagcagacguugcccuuaucagguaugucaacccugauacuggucgcacgcuguuugaggccaaauugcacagaucagguuuuauuacugugucacacacuggugccuacccucuuguggucccuccaaauggucauuucagguuugauucuuggguuaaccaauucuacucacuggcccccaugggaacuggcaaugggcguuaa

SEQ ID NO: 7112 - RNA, 1617 nt, Artificial Sequence
  VP1__Norovirus_and/or_Norovirus-like__JX401280
augaagauggcgucgagugacgccaacccaucugauggguccucagccaaccucgucccagaggucaacaaugagguuauggcuuuggaaccuguuguuggugcugcuauagcagcaccuguggcaggucaacaaaauauaauugaccccuggauuagaaauaauuuugugcaagccccugguggagaguucacaguguccccuagaaacgcuccaggugaaauacuguggagcgcgccucugagcccugauuugaaccccuaucucucucacuuaucuagaauguacaaugguuaugcaggugguuuugaagugcaggugauucuugcggggaaugcguucaccgcgggaaagaucguguuugcugcugucccacccaauuuuccaacugaaggucugagucccagucaagucacaauguuuccucacauaaucguggauguuaggcaauuggaaccugugcugauccccuuaccagauguuagaaauaacuucuaccauuauaaucaagcaaaugauuccacccugaaguugauagcuauguuauacacaccacucagggcuaacaaugccggggaugauguuuucacugucucuugucgaguccuuacaagaccaucuccugacuuugauuuuauuuuccuggucccacccacagucgaaucaagaaccaaaccauucacugucccaguacuuacuguugaagagaugacuaauucaagauuuccuaucccucuagaaagauuauuuacaggccccagcacugcuuuuguuguucagccccaaaauggcagaugcacaacugauggcguccuucuuggcaccacucaguugucggcugucaauaucuguaacuucagaggggaagucaaucacauugccgguacucacgauuacaccaugaggcuaacuucucagaauuggaacaacuaugacccaacagaagagauuccagccccucuugggaccccagacuuuguagggaggauucaaggugugcucacucagaccaccagaagugauggcucgacccgcucccacaaggccacagugagcacggggaguguucacuucacuccaaaauugggcaguguucaguucaccaccgacacaaccaaugaucuuaaugcugggcaaaacacaaaauucaccccggucggugucgagcaaaccagcggcgaccaccaaagugagccucaacaauggacacucccaaauuacucagguacuccaaaucauaaugugcauuuggcccccgcuguugcgcccacuuucccgggugaacagcugcuuuucuuuagguccacucuaccuggguguggcggguacccuaauaugaaucuggacugcuugcucccccaagaguggguuuugcacuucuaccaagaagcugccccagcacaaucugauguggccuugcugagguuuguuaacccagacacaggaagaguguuguuugaauguaagcuccauagaucaggcuucaucacaguggcccacucugguucacaugacuugguuauucccccuaaugguuauuucagauuugauuccuggguuaaucaguuuuacacucucgcccccaugggaaaugggucggggcguagacggguguaa

SEQ ID NO: 7113 - RNA, 1617 nt, Artificial Sequence
  VP1__Norovirus_and/or_Norovirus-like__KC962462
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuaggaacgcuccaggugaaauacuauggagcgcgcccuuaggcccugaucuaaaccccuaccuaucccacuuggccagaauguacaaugguuaugcaggugguuuugaagugcaggugauccuugcggggaacgcguucaccgccgggaagaucauauuugcagcagucccaccaaauuucccaacugaaagcuugagccccagucaggucacuauguucccccauauaauaguagauguuaggcaacuagaaccuguguugauucccuuacccgauguuaggaacaauuucuaccauuauaaucaaucaaaugaccccacuaucaaguugauagcaauguuguacacaccacuuagggcuaauaaugcuggggacgaugucuucacaguuucuugccgaguucucacgaggccaucccccgauuuugacuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgauugacggcgugcuccuagguacuacccaacugucuccugucaacaucugcaccuucagaggggaugucacucauauugcagguacucacaacuacacaaugaauuuggccacucaaaauuggaacaguuaugacccaacagaagaaaucccagccccucuaggaacuccagauuucguggggaagauucaagguguacucacccaaaccacaaagacagauggcucgacacgcggccacaaagcuacagugugcauugggagcgccgacuuugcuccaaaauuggguagaguucaauuugaaacugacacaaacaaugaucuugaaacuaaccaaaacacaaaguucaccccagucggugucauccagaauggugaaacugcccacaggaaugaaccccaacagugggugcucccgaguuacucaggcagaaauacucccaaugugcauuuggcccccgcuguagcccccacuuuuccgggugaacaacuucucuucuucagauccacuaugcccggaugcagcggguaucccaacauggauuuggacugccugcucccccaggaaugggugcaguacuucuaccaagaggcagccccagcacaaucugauguggcucuacuaagauuugugaacccagacacagguaggguuuuguuugaguguaagcuucauaaaucaggcuauguuacaguggcucacacugguucacaugauuugguuauccccccuaaugguuauuuuagguuugauuccugggucaaccaguucuacacacuugcccccaugggaaaugggacggggcguagacguuaa

SEQ ID NO: 7114 - RNA, 1617 nt, Artificial Sequence
  VP1__Norovirus_and/or_Norovirus-like__KX353974
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucacugcgggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauucuaccauuaaauugauagcaaugcuguacacaccacucagggccaauaaugccggggaugaugucuucacagucucuugucgaguccucacgaggccauccccugauuuugacuucauauuucuggugccaccuacaguugagucaagaacuaagccauuuacugucccaaucuugacuguugaagaaaugaccaauucaagauuccccauuccuuuggagaaauuguucacgggucccagcagcgccuuuguuguucaaccacaaaauggcagaugcacaacugauggcgugcucuuaggcaccacccaacugucuccugucaacaucugcaccuucagaggggaugucacccacauugcggguucccguaauuacacaaugaauuuggccucucuaaauuggaacaauuaugacccaacagaagagauuccagccccucugggaacuccagauuucgugggaaagauccaaggugugcucacucaaaccacaaagggagaugguucgacccggggccauaaagcuacaguuuacacugggagugccgacuucacuccaaagcugggcaguguucaauuugguacugauacagaaaaugacuuugaaauucaccaaaauacaagauuuaccccagucggugucauccaggaugguagcaccacccaccgaaaugaaccccaacaaugggugcucccaaguuauucagguagaaguguccauaauguacaccuagccccugcuguagcccccaauuuuccgggugaacaacuucuuuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguagggucuuguuugagugcaaacuccauaaaucaggcuaugucacaguggcucauaccggccaacaugauuuggucaucccccccaauggcuauuuuagguuugauuccuggguuaaucaguucuacacacuugcccccaugggaaauggaacggggcguagacguuaa

SEQ ID NO: 7115 - RNA, 1617 nt, Artificial Sequence
  VP1__Norovirus_and/or_Norovirus-like__KF060122
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugaucuaaauccuuaccuaucccauuuggccagaauguacaauggcuaugcaggugguuuugaagugcagguaauccucgcggggaacgcguucaccgccggaaagaucauauucgcagcagucccaccaaauuucccaacugaaggcuugagccccagccaggucacuauguucccccauauaauaguagauguuaggcaacuggaaccuguguugauucccuuacccgauguuaggaauaauuucuaucauuacaaucaaucaaaugaccccaccaucaaguugauagcaauguuguauacaccacuuagggcuaauaaugcuggggacgacgucuucacaguuucuugccgaguucucacgagaccaucccccgauuuugauuuuauauuuuuagugccacccacaguugagucaagaacuaaaccauucucugucccaguuuuaaccguugaggagaugaccaauucaagguuccccguuccuuuggaaaaguuguucacgggucccagcagugccuuuguuguucaaccacaaaacggcaggugcacgacugauggcgugcuccuagguacuacccaacugucuccugucaacaucugcaccuucagaggggaugucacccauauuacagguagucauaacuacacaaugaauuuggcuucucaaaauuggaacaguuaugacccaacagaagaaaucccagccccucuaggaacuccagauuucguggggaagauucaaggugugcucacccaaaccacaagggcaaauggcucaacacgcggccacaaagcuacaguguacacugggagcgcugacuuugcuccaaaacuggguagaguccaauuugccacugacacaaacaaugauuuugaugcuaaccaaaacacaaaguuuaccccagucggugucauccaggauggugacacugcccaccgaaaugaaccccagcagugggugcucccaaguuacucaggcagaaauagucauaaugugcaucuggcccccgcuguagcccccacuuuuccgggugaacaacuucucuucuucagauccacuaugcccggaugcagcggguaccccaacauggauuuggacugucugcucccccaggaaugggugcaguacuucuaccaagaggcagccccagcacaaucugauguggcucugcuaagguuugugaauccagacacagguaggguuuuguuugaguguaagcuucacaaaucaggcuauguuacaguggcucacacuggccaacaugauuugguuaucccccccaaugguuauuuuagauuugauuccugggucaaccaguucuacacgcuugcccccaugggaaauggaacggggcguagacguuaa

SEQ ID NO: 7116 - RNA, 1617 nt, Artificial Sequence
  VP1__Norovirus_and/or_Norovirus-like__KR904234
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcgcccuuaggcccugauuugaaucccuaucuuucccacuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuagaaccuguuuugauccccuuacccgauguuaggaauaauuucuaucacuauaaccaaucaaaugaccccaccaucaaauugauagcaauguuguauacaccacuuagggcuaauagugcuggggacgaugucuucacgguuucuugucgaguucucacgaggccaucucccgauuuugauuuuauauuuuuagugccacccacaguugaaucaagaacuaaaccauucucugucccaauuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucucccgucaacaucugcuccuucagaggggaugucacccauauugcaggcagucguaacuacacaaugaaccuggcuucccaaaauuggaacaguuaugauccaacagaagaaaucccagccccucuaggaaccccagauuucguggggaagauccaaggugugcucacccaaaccacaaggacagaugguucgacccgcggccacagagcuacaguguacacugggagcgcugacuuuucuccaaaacuggguagaguucaauuugccacugacacagacaaugauuucguugcuaaccaaaacacaaaguucaccccagucgguguuauccaggauggugauacugcccaccgaaaugaaccccaacaaugggugcucccaaguuacucaggcagaaauauucauaaugugcaccuggcccccgcuguagcccccacuuuuccgggugagcaacuccucuucuucagauccaccaugcccggaugcagcggguaccccaacauggauuuggacugucugcucccccaggaaugggugcagcauuucuaccaggaagcagccccagcacaaucugauguggcuuugcuaagauuugugaauccagacacagguaggguucuguuugaguguaagcuucauaaaucaggcuauguuacaguggcucacacuggccaacaugauuuaguuaucccccccaacgguuauuuuagauuugacuccugggucaaccaauucuacacacuugcccccaugggaaaugggacggggcguagacguuaa

SEQ ID NO: 7117 - RNA, 1617 nt, Artificial Sequence
  VP1__Norovirus_and/or_Norovirus-like__KR131769
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguuuacaguguccccuaggaaugcuccaggugagauacuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcaguuccaccuaacuuuccaacugaaggcuugagccccagccagguuacuauguucccccauauaauaguagauguuaggcaauuggaaccuguguugauccccuuaccugauguuaggaauaacuucuaucacuauaaccaaucaaaugacccuaccauuaaauugauagcaaugcuguacacaccacuuagggcuaauaaugcuggggaugaugucuucacagucucuugccgaguccucacgagaccauccccugauuuugauuucauauuucugguaccaccaacaguugaaucaagaaccaaaccauuuaccguuccaaucuuaacuguugaggaaaugaccaauucaagauuccccauuccuuuggaaagguuguacacgggucccagcagugcuauuguuguccagccacaaaacggcaggugcacgacugauggcgugcucuuaggcaccacccagcugucugcugucaacaucugcaccuuuagaggggaugucacucacauugcaggcucucgcaauuauacaaugaauuuggccucucaaaauuggaacaacuaugauccaacagaagaaaucccagccccccuggguaccccagauuucgugggaaaaauccaaggcaugcucacccaaaccacaagaagugauggcucgacccgcggucacaaggccacaguacucacugggagugccgacuucgccccaaaauugggcagaguccaauucgccacugacacagacaacgauuucgaaucuggccaaaacacgaaauucaccccaguuggcgucauccaggaugguuccacuacccaccgaaaugaaccucaacaauggguacucccaaauuacucagguagaacuggucacaaugugcaucuagccccugcuguugcccccacuuacccgggugaacaacuccuuuucuucagguccacuaugcccggauguagcggguaccccaacauggaucuagauugcuugcucccccaggagugggugcagcacuucuaccaagaagcagcuccagcacaaucugauguggcucugcuaagauuugugaauccagacacagguaggguucucuuugagugcaagcuucauaaaucaggauaugucacaguggcucacacuggucagcaugauuugguuauuccccccaaugguuauuuuagauuugauuccugggucaaucaauucuacacacuugcccccaugggaaaugggacggggcguagacguuaa

SEQ ID NO: 7118 - RNA, 1617 nt, Artificial Sequence
  VP1__Norovirus_and/or_Norovirus-like__KR131764
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguuuacaguguccccuagaaaugccccaggugagauauuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcaguuccaccuaacuuuccaacugaaggcuugagccccagccagguuacuauguucccccauauaauaguagauguuaggcaauuggaaccuguguugauccccuuaccugauguuaggaauaacuucuaucacuacaaccagucaaaugacccuaccauuaaauugauagcaauguuguacacaccacuuagggcuaauaaugcuggggaugaugucuucacagucucuugucgaguccucacgagaccauccccugacuuugauuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuaggcaccacccagcugucugcugucaacaucugcaccuuuagaggggaugucacucacauugcaagcucucgcaauuauacaaugaauuuggccucucaaaauuggaacaacuaugauccaacagaagaaaucccagccccccugggcaccccagauuucgugggaaagauccaaggcaugcucacccaaaccacaaaaagugauggcucgacccgcggccacaaggccacagugcucacugggagugccgacuucgccccaaaauugggcagaguccaauucgccacugacacagacaacgauuucgaaucuggccaaaacacgaaauucaccccaguuggcgucauccaggaugguuccacuacccaccgaaaugaaccucaacaauggguacucccaaauuacucagguagaacuggucauaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauguggcucugcuaagauuugugaauccagacacagguaggguucucuuugagugcaagcuccauaaaucaggauaugucacaguagcucacacuggucagcaugauuugguuauucccccuaaugguuauuuuagauuugauuccuggguuaaucaauucuacacacuugcccccaugggaaauggaacggggcguagacguuaa

SEQ ID NO: 7119 - RNA, 1617 nt, Artificial Sequence
  VP1__Norovirus_and/or_Norovirus-like__GU390901
augaagauggcgucgaaugacgccaccccaucugauggguccacagccaaccucgucccagaggucaacaaugagguuauggcuuuggagcccguuguuggugccgccauugcggcaccuguagcgggccaacaaaauguaauugaccccuggauuagaaacaauuuugugcaagccccugguggagaguuuacaguauccccuagaaacgcuccaggugaaauacuguggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagucccagccaggucacuauguucccccacauaauaguagauguuaggcaacuggaaccuguguugauucccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucucccgauuuugauuucauauuuuuagugccacccacaguugagucaagaaccaaaccauucucugucccaauuuuaacuguugaggagaugaccaauucgagauuccccauuccuuuggaaaaguuguucacgggucccagcagugccuuuguuguucaaccacaaaacggcaggugcacgacugauggcgugcuccuagguacuacccaacugucuccugucaacaucugcaccuucagaggggaugucacccauaucacagguagucguaacuacacaaugaauuuggcuacucaaaauuggaauaguuaugacccaacagaagaaaucccagccccucuaggaacuccagauuucguggggaagauccaaggugugcucacccaaaccacaagggcagauggcucgacccgcggccacaaagcuacaguguacacugggagcgccgauuuuucuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagaucuacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccucccaaugguuacuuuagauuugauuccugggucaaccaguucuacacacuugcccccaugggaaauggaacggggcguagacguuaa

SEQ ID NO: 7120 - RNA, 1617 nt, Artificial Sequence
  VP1__Norovirus_and/or_Norovirus-like__EU078408
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucugaaucccuaccuuucucauuuggccagaauguacaaugguuaugcaggugguuuugaggugcagguaauccucgcggggaacgcguucaccgccgggaaaaucauauuugcagcaguuccaccaaauuuuccaacugaaggcuugagccccagccaggucacuauguucccccauauaauaguagauguuaggcaacuggaaccuguguugauccccuuaccugauguuaggaauaauuucuaucacuauaaucaaucaaaugacccuaccauuaaauugauagcaaugcuguacacaccacuuagggcuaauaaugcuggggacgaugucuucacagucucuugucgaguccucacgaggccaucccccgauuuugauuucauauuuuuggugccacccacaguugagucaagaacuagaccauucaccgucccaauuuuaacuguugaggaaaugaccaauucaagauuccccauuccuuuggaaaaguuauucacgggucccagcggugccuuuguuguucaaccacaaaauggcaggugcacgacugauggcgugcucuuaggcacuacccaacugucuccugucaacaucugcaccuucagaggggaugucacccacauugcaggcacucaugauuacacaaugaauuuggcuucucaaaauuggaacaauuaugacccaacagaagaaaucccagccccucugggaacuccagauuucgugggaaagauccaaggcgugcucucccaaaccacaaggggggacggcucgacccgcggccacaaagcuacagugagcacugggaguguccacuucacuccaaagcugggcaguguucaguucaccacugauacaaacaaugaucuugaaacuggccaaaacacgaaauucaccccagucggugucguccaggaugguaacaguacccaccaaaaugaaccccaacaaugggugcucccaaauuacucagguagaacuggucauaauguacaccuagccccugccguagcccccacuuuuccgggugagcaacugcuuuucuucagguccacuaugcccggaugcagcggguaucccaacaugaauuuggauuguuuacucccacaggaaugggugcagcacuucuaucaagaggcagcuccagcacaaucugauguggcucugcugagauuugugaauccagacacagguaggguucuguuugagugcaagcuucauaaaucaggcuaugucacgguggcucacacuggccaacaugauuuggucaucccccccaauggcuacuuuagauuugauuccugggucaaccaauucuacacacuugcccccaugggaaauggagcggggcguagacguuaa

SEQ ID NO: 7121 - RNA, 1617 nt, Artificial Sequence
  VP1__Norovirus_and/or_Norovirus-like__AB933676
augaagauggcgucuaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaauucacaguauccccuagaaaugcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcugucccaccaaauuuuccaacugaaggcuugagucccagccaggucacuauguuuccccacauaauaguggauguuaggcaauuggaaccuguguugauccccuuaccugauguuaggaauaacuucuaccacuauaaucagucaaaugauucuaccauuaaauugauagcaaugcuguauacaccacuuagggcuaauaaugcuggggaugaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucagcaucugcaccuucagaggggaugucacccacauugcagguucucgugauuacacaaugaauuuggcuucucuaaauuggaacaacuaugacccaacagaagaaauuccagccccucuaggaaccccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccgcccaccgaaaugaaccccaacaaugggugcucccaaguuauucagguagaaauguccaaaauguacaccuagccccugcuguagcccccacguuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcccacaccggccagcaugauuuggucaucccccccaaugguuauuuuagguuugauuccuggguuaaucaauucuacacacuugcccccaugggaaauggaacggggcguagacguuaa

SEQ ID NO: 7122 - RNA, 1617 nt, Artificial Sequence
  VP1__Norovirus_and/or_Norovirus-like__KX354082
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaguuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauucuaccauuaaauugauagcaaugcuguacacaccacucagggccaauaaugccggggaugaugucuucacagucucuugucgaguccucacgaggccauccccugauuuugacuucauauuucuggugccaccuacaguugagucaagaacuaagccauuuacugucccaaucuugacuguugaagaaaugaccaauucaagauuccccauuccuuuggagaaauuguucacgggucccagcagugccuuuguuguucaaccacaaaauggcagaugcacaacugauggcgugcucuuaggcacuacccaacugucuccugucaacaucugcaccuucagaggggaugucacccacauugcggguucccguaauuacacaaugaauuuggccucucuaaauuggaacaauuaugacccaacagaagagauuccagccccucugggaacuccagauuucgugggaaagauccaaggugugcucacucaaaccacaaagagagauggcucgacccggggccauaaagcuacaguuuacacugggagugccgacuucacuccaaagcugggcaguguucaauuugguacugacacagaaaaugacuuugaaacucaccaaaacacaagauuuaccccagucggugucauucaggaugguagcaccacccaccgaaaugaaccccaacaaugggugcucccaaguuauucaggcagaaauguccauaauguacaccuagccccugcuguagcccccaauuuuccaggugaacaacuccuuuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguagggucuuguuugagugcaaacuccauaaaucaggcuaugucacaguggcucauaccggccaacaugauuuggucaucccccccaaugguuauuuuagguuugauuccuggguuaaucaguucuacacacuugcccccaugggaaauggaacggggcguagacguuaa

SEQ ID NO: 7123 - RNA, 1617 nt, Artificial Sequence
  VP1__Norovirus_and/or_Norovirus-like__KJ407076
augaagauggcgucgaaugacgccagcccaucugauggguccacagccaaccucgucccagaggucaacaaugagguuauggcuuuggagcccguuguuggugccgcuaucgcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaacccguguugauccccuuaccugauguuaggaauaacuucuaucauuauaaccaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguacacgggucccagcagugcuuuuguuguccaaccacaaaauggcaggugcacgacugacggcgugcucuuaggcacuacccagcugucugcugucaacaucugcaccuucagaggggaugucacccacauugcaggcagucaugacuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagccacagugagcacugggaguguccacuuuacuccaaagcugggcaguguucaauacaccacugacacaaacaaugauuuucaaacuggccaaaacacgaaauucaccccagucggcgucauccaggacgguaauaaccaucaaaaugaaccccaacaauggguacuuccaaauuacucagguagaacuggucauaaugugcaccuagcuccugccguugcccccacuuucccgggugagcaacuucucuucuuuagguccacuaugcccggguguagcggguaucccaacaugaaucuggauugccuacucccccaggaaugggugcagcacuucuaccaagaagcagccccagcacaaucugauguggcucugcugagauuugugaauccagacacagguaggguucuguuugagugcaagcuccauaaaucaggcuaugucacaguggcucacacuggcccacaugauuugguuaucccccccaaugguuacuuuagauuugauuccugggucaaccaguucuacacacuugcccccaugggaaauggagcggggcgcagacguguauaa

SEQ ID NO: 7124 - RNA, 1617 nt, Artificial Sequence
  VP1__Norovirus_and/or_Norovirus-like__JX459636
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaacgguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacugucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacgacugacggcgugcucuuaggcaccacccaacugucuccugucaacaucugcaccuucagaggggaugucacccacauugcagguucucgugacuacacaaugaauuuggccucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguagcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacguuaa

SEQ ID NO: 7125 - RNA, 1617 nt, Artificial Sequence
  VP1__Norovirus_and/or_Norovirus-like__JX445161
augaagauggcgucgaaugacgccaccccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgccccuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagaugucaggcaacuggaaccuguguugauucccuuacccgauguuaggaauaauuucuaucacuacaaucaaucaaacgaccccaccaucaaauugauagcaauguuguacacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauccaaggugugcucacccaaaccacaagggcagauggcucuacccgcggccacaaagcuacaguguacacugggagcgccgauuuugcuccaaaacuggguagaguucaauuugccacugacacagauaaugauuuugaugcuaaccaaaacacaaaguucaccccagucggugucauccaggauggugauacugcccaccgaaaugaaccccaacaauggguacucccaaguuacucaggcagaaauagucacaaugugcaccuggcccccgcuguagcccccacuuuuccgggugagcaacuucucuucuucagaucuacuaugcccggaugcagcggguaccccaacauggauuuggacugucugcucccccaggaaugggugcaguacuucuaucaagaggcagccccagcacaaucugauguggcucugcuaagauuugugaauccagacacagguaggguuuuguuugaguguaagcuucauaaaucaggcuauguuacaguggcucacaccggccaacaugacuugguuaucccccccaaugguuauuuuagauuugauuccugggucaaccaguucuacacacuugcccccaugggaaauggaacggggcguagacguuaa

SEQ ID NO: 7126 - RNA, 1617 nt, Artificial Sequence
  VP1__Norovirus_and/or_Norovirus-like__EU876888
augaagauggcgucgagugacgccagcccaucugauggguccgcagccaaccucgucccagaggucaacaaugagguuauggcucuggagcccguuguuggugccgcuauugcggcaccuguagcgggccaacaaaacauaauugaccccuggauuagaaauaauuuuguacaagccccugguggagaauucacagugucccccagaaaugcuccaggugaaauacuauggagcgcaccuuuaggcccugauuugaaccccuaccuuucccauuugucuagaauguauaaugguuaugcaggugguuuugaagugcaagugauccucgcggggaaugcguucaccgccgggaaggucauauuugcagcagucccuccaaauuuuccaacugaaggucuaagcccuagucaaguuacuauguucccccauauaauuguagauguuagacaauuggagccuguguugaucccucuacccgauguuaggaauaauuuuuaccauuacaaucagacaaaugacccuaccauuaaauugauagcaauguuguauacaccacucagagcuaauaaugcuggggacgacgucuucacagucucuugucgaguccucacgagaccauccccugauuuugauuucauauucuuagugccaccaacaguugaaucaagaacuaaaccguuuacugucccaaucuuaacuguugaggaaaugaccaacucuagauuccccauuccuuuggaaagguuguacacgggucccagcagugcuuuuguuguccagccacaaaauggcaggugcacgacugauggcgugcucuuaggcaccacccagcugucugcugucaacaucugcaccuucaggggggaugucacccacauugcaggcucccguaauuauacaaugaauuuggccucucaaaauuggaacaauuaugacccaacagaagaaaucccagccccucuggggaccccagauuuuguagggaagauccaaggcaugcucacccaaaccacaagaggagauggcucgacucguggccacaaagccacaguguacacugggagugccgacuuugccccaaaacugggcagaguucaauuugcuacugacacagacaacgauuuugaauccaaucaaaacacaaaauucaccccagucggugucauccaggaugguaacaccacccaucgaaaugaaccccaacaauggguacucccagguuacucagguagagauggucacaauguacaccuagccccugccgucgcccccaccuacccgggugagcaacuccuuuucuuuagguccaccaugcccggauguagcggguaucccaacauggaucuagauugcuuacucccccaggaaugggugcagcacuucuaccaagaagcagcuccagcacaaucugaaguggcucugcuaagauuugugaauccagauacagguaggguuuuguuugagugcaagcuccauaaaucaggguaugucacaguggcucauacuggucagcaugauuugguuauuccccccaaugguuauuuuagauuugauuccuggguuaaccaguuuuacacacuugcccccaugggaaauggagcggggcguaggcguuaa

SEQ ID NO: 7127 - RNA, 1617 nt, Artificial Sequence
  VP1__Norovirus_and/or_Norovirus-like__EU839584
augaagauggcgucgaaugacgccaccccaucugacggguccacagccaaccucgucccagaggucaacaaugagguuauggcuuuggagcccguuguuggugccgcgauugcggcaccuguagcgggccaacaaaauguaauugaccccuggauuagaaacaauuuuguacaagccccugguggagaguuuacaguauccccuagaaacgcuccaggugaaauauuauggagcgcacccuugggcccugauuugaaucccuaccuuucccacuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuuuuaucauuacaaccaaucaaaugaccccaccaucaaauugauagcaaugcuguauacaccacucagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucagccacaaaauggcagaugcacgacugauggcgugcucuuagguacuacccaauugucuccugucaacaucugcaccuucagaggggacgucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaagagggauggcucgacccgcggucacaaagccacagugagcacuggaaguguccacuuuaccccaaagcugggcaguguucaguucuccacugauacaagcaaugacuuugaaauuggccaaaacacaagauucaccccagucgguguuguccaagaugguaguaccacccaccaaaaugaaccccaacaaugggugcucccaaacuauucagguagagauggucacaauguacaccuagccccugcuguggcccccacuuucccgggugagcaacuucuuuucuuuagguccacuaugcccggaugcagcggguaucccaacaugaauuuggauugccuacucccccaggagugggugcaacacuucuaccaagagucagcuccagcacaaucugauguggcacuguugagauuugugaauccagacacagguagggccuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7128 - RNA, 1617 nt, Artificial Sequence
  VP1__Norovirus_and/or_Norovirus-like__KX354090
augaagauggcgucgaaugacgccaacccaucugauggguccgcagccaaccucgucccagaggucaacaaugagguuauggcuuuggagcccguugucggugccgcuauugcggcgccuguagcgggucaacaaaauguaauugaccccuggauuagaaguaacuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauucuaccauuaaauugauagcaaugcuguacacaccacucagggccaauaaugccggggaugaugucuucacagucucuugucgaguccucacgaggccauccccugauuuugacuucauauuucuggugccaccuacaguugagucaagaacuaagccauuuacugucccaaucuugacuguugaagaaaugaccaauucaagauuccccauuccuuuggagaaauuguucacgggucccagcagugccuuuguuguucaaccacaaaauggcagaugcacaacugauggcgugcucuuaggcaccacccaacugucuccugucaacaucugcaccuucagaggggaugucacccacauugcggguucccguaauuacacaaugaauuuggccucucuaaauuggaacaauuaugacccaacagaagagauuccagccccuuugggaacuccagauuucgugggaaagauccaaggugugcucacucaaaccacaaagggagauggcucgacccggggccauaaggcuacaguuuacacugggagugccgacuucacuccaaagcugggcaguguucaauuugguacugauacagaaaaugacuuugaaacucaccaaaacacaagauuuaccccagucggugucauccaggaugguagcaccacccaccgaaaugaaccccaacaaugggugcucccaaguuauucaggcagaaauguccauaauguacaccuagccccugcuguagcccccaauuuuccgggugaacaacuucuuuucuucagguccacuaugcccggaugcaguggguaucccaacauggauuuggauugccuacucccccaggagugggugcaacacuucuaccaagaggcagcuccagcacaaucugauguggcucuauugagauuugugaauccagacacggguagggucuuguuugagugcaaacuccauaaaucaggcuaugucacaguggcucauaccggccaacaugauuuggucaucccccccaaugguuauuuuagguuugauuccuggguuaaucaguucuauacacuugcccccaugggaaauggaacggggcguagacguuaa

SEQ ID NO: 7129 - RNA, 1617 nt, Artificial Sequence
  VP1__Norovirus_and/or_Norovirus-like__KF060124
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugaucuaaauccuuaccuaucccauuuggccagaauguacaauggcuaugcaggugguuuugaagugcagguaauccucgcggggaacgcguucaccgccggaaagaucauauucgcagcagucccaccaaauuucccaacugaaggcuugagccccagccaggucacuauguucccccauauaauaguagauguuaggcaacuggaaccuguguugauucccuuacccgauguuaggaauaauuucuaucauuacaaucaaucaaaugaccccaccaucaaguugauagcaauguuguauacaccacuuagggcuaauaaugcuggggacgacgucuucacaguuucuugccgaguucucacgagaccaucccccgauuuugauuuuauauuuuuagugccacccacaguugagucaagaacuaaaccauucucugucccaguuuuaaccguugaggagaugaccaauucaagguuccccguuccuuuggaaaaguuguucacgggucccagcagugccuuuguuguucaaccacaaaacggcaggugcacgacugauggcgugcuccuagguacuacccaacugucuccugucaacaucugcaccuucagaggggaugucacccauauuacagguagucauaacuacacaaugaauuuggcuucucaaaauuggaacaguuaugacccaacagaagaaaucccagccccucuaggaacuccagauuucguggggaagauucaaggugugcucacccaaaccacaagggcagauggcucaacacgcggccacaaagcuacaguguacacugggagcgcugacuuugcuccaaaacuggguagaguccaauuugccacugacacaaacaaugauuuugaugcuaaccaaaacacaaaguuuaccccagucggugucauccaggauggugacacugcccaccgaaaugaaccccagcagugggugcucccaaguuacucaggcagaaauagucauaaugugcaucuggcccccgcuguagcccccacuuuuccgggugaacaacuucucuucuucagauccacuaugcccggaugcagcggguaccccaacauggauuuggacugucugcucccccaggaaugggugcaguacuucuaccaagaggcagccccagcacaaucugauguggcucugcuaagguuugugaauccagacacagguaggguuuuguuugaguguaagcuucacaaaucaggcuauguuacaguggcucacacuggccaacaugauuugguuaucccccccaaugguuauuuuagauuugauuccugggucaaccaguucuacacgcuugcccccaugggaaauggaacggggcguagacguuaa

SEQ ID NO: 7130 - RNA, 1617 nt, Artificial Sequence
  VP1__Norovirus_and/or_Norovirus-like__JX439826
augaagauggcgucgagugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguguccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucaccauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugacuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcagaugcacgacugauggcgugcuccuagguaccacucaacugucuccugucaacaucugcaccuucagaggggaugucacccauaucacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugacacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugccugcucccccaggaaugggugcaguauuucuaucaagaggcagccccagcacaaucugauguggcucugcuaagauuugugaauccagacacagguaggguuuuguuugaguguaaacuucauaaaucaggcuauguuacaguggcucacaccggucaacaugauuugguuaucccccccaaugguuauuuuagauuugauuccugggucaaccaguucuacacacuugcccccaugggaaauggaacggggcguagacguuaa

SEQ ID NO: 7131 - RNA, 1617 nt, Artificial Sequence
  VP1__Norovirus_and/or_Norovirus-like__JX439815
augaagauggcgucgaaugacgccaacccaucugauggguccacagccaaccucgucccagaggucaacaaugagguuauggcuuuggagcccguuguuggugccgccauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaauugauagccauguuguauacaccacuuagggcuaauaaugcuggggacgaugucuucacaguuucuugucggguacucacgagaccaucccccgauuuugauuucauauuucuagugccacccacaguugaaucaagaacuaaaccauucucugucccaauuuuaacuguugaggagaugaccaauucaagauuccccauuccuuuggaaaagcuguucacgggcccuagcagugccuuuguuguucaaccacaaaacggcaggugcacgacugauggcgugcuccuggguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggccacaaagcuacaguguacacugggagcgccgacuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggcgagcaacuucucuucuucagauccacuaugcccggaugcagcggguaccccaacauggauuuggacugucugcuuccccaggaaugggugcaguauuucuaucaagaggcagccccagcacaaucugauguggcacugcuaagauuugugaauccagacacagguaggguuuuguuugaguguaagcuucauaaaucaggcuauguuacuguggcucacaccggccaacaugauuugguuaucccccccaaugguuauuucagauuugauuccugggucaaccaguucuacacacuugcccccaugggaaauggaacggggcguagacguuaa

SEQ ID NO: 7132 - RNA, 1617 nt, Artificial Sequence
  VP1__Norovirus_and/or_Norovirus-like__KC576912
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuuuggagcgcgcccuuaggcccugaucugaaucccuaccuaucucauuuggccagaauguauaaugguuaugcaggugguuuugaagugcagaugauccucgcggggaacgcguucaccgcgggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauccuaccauuaaauugauagcaaugcuguauacaccacucagggccaauaaugccggggaugaugucuucacagucucuugucgaguccucacgaggccauccccugauuuugacuucauauuucuggugccaccuacaguugagucaagaacuaaaccauuuacugucccagucuugacuguugaagaaaugaccaauucaagauuccccauuccuuuggagaaauuguucacgggucccagcagugccuuuguuguucaaccacaaaauggcagaugcacaacugauggcgugcucuuaggcaccacccagcugucuccugucaacaucugcaccuucagaggggaugucacccacauugcggguucccguaauuacacaaugaauuuggccucucuaaauuggaacaauuaugacccaacagaagagauuccagccccucugggaacuccagauuucgugggaaagauccaaggugugcucacucaaaccacaaagggagauggcucgacccggggccauaaagcuacaguuuacacugggagugccgacuucacuccaaagcugggcaguguucaauuugguacugauacagauaaugacuuugaaacucaccaaaacacaagauuuaccccagucggugucauccaggauggugcgaccacccaccgaaaugaaccccaacaaugggugcucccaaguuauucaggaagaaauguccauaauguacaccuagccccugcuguagcccccaauuuuccgggcgaacaacuucuuuucuucagguccacuaugcccggaugcagcggguaucccaacauggauuuggauugccuacucccccaggagugggugcaacacuucuaccaagaggcagcuccagcacaauccgauguggcucuauugagauuugugaauccagacacggguagggucuuguuugagugcaaacuccauaaaucaggcuaugucacaguggcucauaccggccaacaugauuuggucaucccccccaaugguuauuuuagguuugauuccuggguuaaucaguucuacacacuugcccccaugggaaauggaacggggcgcagacguuaa

SEQ ID NO: 7133 - RNA, 1617 nt, Artificial Sequence
  VP1__Norovirus_and/or_Norovirus-like__GQ845368
augaagauggcgucgagugacgccagcccaucugauggguccgcagccaaccucgucccagaggucaacaaugagguuauggcucuggagcccguuguuggugccgcuauugcggcaccuguagcgggccaacaaaacauaauugaccccuggauuagaaauaauuuuguacaagccccugguggagaauucacagugucccccagaaaugcuccaggugaaauacuauggagcgcaccuuuaggcccugauuugaaucccuaccuuucccauuugucuagaauguauaaugguuaugcaggugguuuugaagugcaagugauccucgcggggaacgcguucaccgccgggaaggucauauuugcagcagucccuccaaacuuuccaacugaaggucuaagcccuagucaaguuaccauguucccccauauaauuguagauguuagacaauuggagccuguguugauuccccuaccugauguuaggaauaauuuuuaccauuacaaucaaacaaaugacccuaccauuaaauugauagcaauguuguauacaccacuuagagcuaauaaugcuggggacgaugucuucacagucucuugucgaguccucacgagaccauccccugauuuugacuucauauucuuagugccacccacaguugaauccagaacuaaaccauuuacugucccaaucuuaacuguugaggaaaugaccaacucuagauuccccauuccuuuggaaagguuguacacgggucccagcagugcuuuuguuguccagccacaaaauggcaggugcacgacugauggcgugcucuuaggcaccacccagcugucugcugucaacaucugcaccuucaggggggaugucacccacauuacaggcucccguaauuauacaaugaauuuggccucucaaaauuggaacaauuaugacccaacagaagaaauuccagccccucuggggaccccagauuuugugggaaagauccaaggcaugcucacccaaaccacaagaggagauggcucgacucguggccacaaagccacaguguacacugggagugccgacuucgccccaaaauugggcagaguucaauucgcuacugacacagacaaugauuuugaauccaaccaaaacacaaaauucaccccagucggugucauccaggauggcaacaccacccaucaaaaugaaccccaacaauggguacucccagguuacucagguagagauggccacaauguacaccuagccccugccgucgcccccaccuacccgggugagcaacuccuuuucuuuagguccaccaugcccggauguagcggguaucccaacaugaaucuagauugcuuacucccccaggaaugggugcagcacuucuaccaagaagcagcuccagcacaaucugaaguggcucugcuaagauuugugaauccagauacagguaggguuuuguuugagugcaagcuccauaaaucaggguaugucacaguggcucauacuggucagcaugauuugguuauuccccccaaugguuauuuuagauuugauuccugggucaaccaguuuuacacacuugcccccaugggaaauggagcggggcguagacguuaa

SEQ ID NO: 7134 - RNA, 1617 nt, Artificial Sequence
  VP1__Norovirus_and/or_Norovirus-like__AB541249
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagacgucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacguuaa

SEQ ID NO: 7135 - RNA, 1617 nt, Artificial Sequence
  VP1__Norovirus_and/or_Norovirus-like__EU078412
augaagauggcgucgaaugacgccagcccaucugauggguccacagccaaccucgucccagaggucaacaaugagguuauggcuuuggagcccguuguuggugccgcaauugcggcaccuguagcgggccaacaaaauguaauugaccccuggauuagaaguaauuuuguacaagccccugguggagaguucacaguauccccuagaaacgcuccaggugaaauacuauggagcgcgcccuugggcccugaucugaaucccuaccuuucucauuuggccagaauguacaaugguuaugcaggugguuuugaagugcagguaauucucgcggggaaugcguuuaccgccgggaaaaucauauuugcagcaguuccaccaaauuucccaacugaaggcuugagccccagccaggucacuauguucccccauauaauaguagauguuaggcaacuggaaccuguguugauccccuuaccugauguuaggaauaauuucuaucacuauaaucaguugaaugaccccaccauuaagcugauagcaaugcuguauacaccacuuagggccaauaaugcuggggacgaugucuucacagucucuugucgaguccucacgaggccaucccccgauuuugauuucauauuuuuggugccacccacaguugagucaagaacuaagccauucaccgucccaauuuugacuguugaggaaaugaccaauucaagauuccccauuccuuuggaaaaguuauucacgggucccaguggugccuuuguuguucaaccacaaaauggcagaugcacgacugauggcgugcucuuaggcacuacccagcugucuccugucaacaucugcaccuucagaggggaugucacccacauugcagguacucaugauuacacaaugaauuuggcuucucaaaauuggaacaacuacgacccaacagaagaaaucccagccccucugggaaccccagauuucgugggaaagauccaaggcgugcucacucaaaccacaaggggagauggcucgacccguggccacaaagcuacagugagcacugggaguguccacuuuacuccaaagcugggcaguguucaauucaccacugauacaaacaaugaucuugaaacuggccaaaacacgagauucaccccagucggugucguccaggaugguaauaguacccaccaaaaugaaccccaacaaugggugcucccaaauuacucagguagagcuggccacaauguacaccuagccccugccguagcccccacuuuuccgggcgagcaacuucuuuucuucagguccacuaugcccgggugcagcggguaucccaacaugaauuuggauugccuacuuccccaggaaugggugcagcacuucuaccaagaggcagcuccagcacaaucugacguggcucugcuaagauuugugaauccagacacagguaggguccuguuugagugcaaacuucauaaaucagguuaugucacaguggcucacacuggccagcaugauuugguuaucccccccaauggcuauuuuagauuugauuccugggucaaccaauucuacacacuugcccccaugggaaauggagcggggcgccggcguuaa

SEQ ID NO: 7136 - RNA, 1617 nt, Artificial Sequence
  VP1__Norovirus_and/or_Norovirus-like__AB445395
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccggaaaaaucauauuugcagcagucccaccaaacuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaguugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuaggcaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauaaucacaaugugcaccuggcccccgcuguagcccccacuuuuccgggugagcaacuucucuucuucagauccacuaugcccggaugcaguggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7137 - RNA, 1617 nt, Artificial Sequence
  VP1__Norovirus_and/or_Norovirus-like__AB933655
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaagugauccucgcggggaacgcguucaccgccgggaaaauuauauuugcagcagucccaccaaauuuuccaacugaagguuugagucccagccagguuacuauguucccccacauaauaguagauguuaggcaauuggaaccuguguugaucccuuuaccugauguuaggaauaacuucuaccacuauaaucagucaaaugauucuaccauuaaauugauagcaaugcuguacacaccacuuagggccaauaaugcuggggaugaugucuucacagucucuugucgaguccucacgagaccauccccugauuuugauuuuauauuucuggugccacccacaguugagucaagaaccaagccauucacugucccaaucuuaacuguugaagaaaugaccaauucaagauuccccauuccuuuggaaaaacuguucacgggucccagcagugccuuuguuguucaaccacaaaauggcagaugcacuacugauggcgugcucuuaggcaccacccaacugucuccugucaacaucugcaccuucagaggagaugucacccacauugcggguucccgcaauuacacaaugaauuuggccucucuaaauuggaacaauuacgacccaacagaagaaauuccagccccccugggaacuccagauuuugugggaaagauccaaggugugcucacucaaaccacaaagggagacggcucgacccggggccauaaagcuacaguuuacacugggagugccgacuuuacuccaaagcugggcaguguccaauuugguacugauacagaaaaugacuuugaaacucaccaaaacacaaaauucaccccaguaggugucauccaggaugguagcaccacccaccgaaaugaaccccaacaaugggugcucccaaguuauucagguagaaauguccauaauguacaccuagccccugcuguagcucccaauuuuccgggugaacaacuucuuuucuucagguccacuaugcccggauguagcggguaucccaacauggauuuggauugccugcucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccaacaugauuuggucaucccccccaauggcuauuuuagguuugauuccuggguuaaccaauucuacacacuugcccccaugggaaauggaacggggcguagacguuaa

SEQ ID NO: 7138 - RNA, 1617 nt, Artificial Sequence
  VP1__Norovirus_and/or_Norovirus-like__KM245072
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaagcaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggagacgaugucuucacaguuucuugucggguucucacgagaccaucccccgacuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuaggcaccacucaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccauaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucauaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugagugcaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7139 - RNA, 1617 nt, Artificial Sequence
  VP1__Norovirus_and/or_Norovirus-like__AB541282
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggacgaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccaucccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacguuaa

SEQ ID NO: 7140 - RNA, 1617 nt, Artificial Sequence
  VP1__Norovirus_and/or_Norovirus-like__AB541202
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaguccucgcggggaacgcguucaccgccggaaaaaucauauuugcagcagucccaccaaauuucccaacugaaggcuugagccccagccaggucacuauguucccccacauaauaguagaugucagacaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccuauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccggccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccucaacaaugggugcucccaaguuacucaggcagaaauaaucauaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcugagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7141 - RNA, 1617 nt, Artificial Sequence
  VP1__Norovirus_and/or_Norovirus-like__FJ514242
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaccacuauaaucagucaaaugauccuaccauuaaauugauagcaaugcuguauacaccacuuagggcuaauaaugcuggggaggaugucuucacagucucuugucgaguucucacgaggccauccccugauuuugauuuuauauuuuuggugccaccuacaguugagucaagaacuaaaccauuuacugucccaauccuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaguuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcgcaggcguuaa

SEQ ID NO: 7142 - RNA, 1617 nt, Artificial Sequence
  VP1__Norovirus_and/or_Norovirus-like__KX353976
augaagauggcgucgaaugacgcuaacccaucugauggguccgcagccaaccucgucccagaggucaacaaugagguuauggcuuuagagcccguugucggugccgcuauugcggcgccuguagcgggccaacaaaauguaauugaccccuggauuagaaauaauuuuguacaagccccugguggagaguucacaguuuccccuagaaacgcuccaggugaaauacuauggagcgcgcccuuaggcccugaucugaaccccuaccuaucucauuuggccagaauguauaaugguuaugcaggugguuuugaagugcaggugauccucgcggggaacgcguucaccgcuggaaagguuauauuugcagcagucccaccaaauuucccaacugaaggcuugagccccagccaggucacuauguucccccacauaauaguagauguuaggcaguuggaaccuguguugauccccuuaccugauauuaggaauaacuucuaucauuauaaccagucaaaugauucuacuauuaaauugauagcaauguuguacacaccacuuagggccaauaaugccggggaugaugucuucacagucucuugucgaguccucacgaggccuuccccugauuuugauuucauauucuuggugccaccuacaguugagucuagaaccaagccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuagguaccacccaauugucuccugucaacaucugcaccuucagaggggaugucacccacauugcggguucucguaacuacacaaugaacuuggccucucuaaauuggaacaauuaugacccaacagaagaaauuccagccccucuggggacuccagauuucgugggaaagauccaaggugugcucacucaaaccacaaagggagauggcucgacccggggacauaaagccacaguuuacacugggagugccgacuucaccccaaagcugggcaguguucaauuugguacugauacagauaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccaauuuuccgggugaacaacuucuuuucuucagguccacuaugcccggaugcagcggguaucccaacauggauuuggauugccugcucccccaggaaugggugcagcacuucuaccaagaggcagccccagcacaaucugauguggcucuauugagauuugugaauccagacacggguaggguccuguuugagugcaaacuucauaaaucaggcuaugucacaguggcucacaccggccaacaugauuugguuaucccccccaauggcuauuuuagguuugauuccuggguuaaucaauucuacacacuugcccccaugggaaauggaacggggcguagacguuaa

SEQ ID NO: 7143 - RNA, 1617 nt, Artificial Sequence
  VP1__Norovirus_and/or_Norovirus-like__KX353952
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucauuauaaccagucaaaugauucuaccauuaaguugauagcaaugcuguacacaccacucagggccaauaaugccggggaugaugucuucacagucucuugucgaguccucacgaggccauccccugauuuugacuucauauuucuggugccaccuacaguugagucaagaacuaagccauuuacugucccaaucuugacuguugaagaaaugaccaauucaagauuccccauuccuuuggagaaauuguucacgggucccagcagcgccuuuguuguucaaccacaaaauggcagaugcacaacugauggcgugcucuuaggcaccacccaacugucuccugucaacgucugcaccuucagaggggaugucacccacaucgcggguucccguaauuacacaaugaauuuggccucucuaaauuggaacaauuaugacccaacagaagagauuccagccccucugggaacuccagauuucgugggaaagauccaaggugugcucacucaaaccacaaagggagaugguucgacccggggccauaaagcuacaguuuacacugggagugccgacuucacuccaaagcugggcaguguucaauuugguacugauacagaaaaugacuuugaaacucaccaaaacacaagauuuaccccagucggugucauccaggaugguagcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguagggucuuguuugagugcaaacuccauaaaucaggcuauguuacaguggcucauaccggccaacaugauuuggucaucccccccaauggcuauuuuagguuugauuccuggguuaaucaguucuacacacuugcccccaugggaaauggaacggggcguagacguuaa

SEQ ID NO: 7144 - RNA, 1617 nt, Artificial Sequence
  VP1__Norovirus_and/or_Norovirus-like__KR131771
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguuuacaguguccccuagaaacgcuccaggugagauacuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcaguuccaccuaacuuuccaacugaaggcuugagccccagccagguuacuauguucccccauauaauaguagauguuaggcaauuggaaccuguguugauccccuuaccugauguuaggaauaacuucuaucacuacaaccaaucaaaugacccuaccauuaaauugauagcaaugcuguacacaccacuuagggcuaauaaugcuggggaugaugucuucacagucucuugucgaguccucacgagaccauccccugacuuugauuucauauuucugguaccaccaacaguugaaucaagaaccaaaccauuuaccguuccaaucuuaacuguugaggaaaugaccaauucaagauuccccauuccuuuggaaagguuguauacgggucccagcagugcuuuuguuguccagccacaaaacggcaggugcacgacugauggcgugcucuuaggcaccacccagcugucugcugucaacaucugcaccuuuagaggggaugucacccacauugcaggcucucgcaauuauacaaugaauuuggccucucaaaauuggaacaacuacgauccaacagaagaaaucccagccccccugggcaccccagauuucgugggaaagauccaaggcaugcucacccaaaccacaagaagugauggcucgacccgcggccauaaggccacagugcucacugggagugccgacuucgccccaaaauugggcagaguccaauucgccacugacacagacaacgauuucgaaucuggccaaaacacgaaauucaccccaguuggcgucauccaggaugguuccacuacccaccgaaaugaaccucaacaauggguacucccaaauuacucagguagaacuggucauaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauguggcucugcuaagauuugugaauccagacacagguaggguucucuuugagugcaagcuccauaaaucaggauaugucacaguggcucacacuggucagcaugauuugguuauuccccccaauggcuauuuuagauuugauuccuggguuaaucaauucuacacacuugcccccaugggaaauggaacggggcguagacguuaa

SEQ ID NO: 7145 - RNA, 1617 nt, Artificial Sequence
  VP1__Norovirus_and/or_Norovirus-like__AB933729
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugacuucauauuuuuaguaccacccacaguugagucaagaacuaaaccauucucuguuccaauuuuaacuguugaggagaugaccaauucaagauuccccauuccuuuggaaaagcuguucacgggucccagcagugccuuuguuguucaaccacaaaacggcagaugcacgacugauggcgugcuccuagguaccacucaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuauaguguacacugggagcgccgauuucgcuccaaaacuggguagaguucaauuugccacugacacagacaaugauuuuggugcuaaccaaaauacaaaguucaccccagucggugucauccaggauggugacacugcccaccgaaaugaaccccaacaaugggugcucccaaguuacucaggcagaaauagucacaaugugcaccuggcucccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggucaacaugauuugguuaucccccccaaugguuauuuuagauuugauuccugggucaaccaguucuacacacuugcccccaugggaaaugggacggggcguagacguuaa

SEQ ID NO: 7146 - RNA, 1617 nt, Artificial Sequence
  VP1__Norovirus_and/or_Norovirus-like__AB933646
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuacuauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuugggcaccacccaacugucuccugucaacaucugcacuuucagaggggaugucacccacauugcagguucucgugauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugacuuugaaacucaccaaaacacaaaguucaccccagucgguguuauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugaaguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacguuaa

SEQ ID NO: 7147 - RNA, 1617 nt, Artificial Sequence
  VP1__Norovirus_and/or_Norovirus-like__JX155742
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuugccugauguuaggaauaacuucuaucacuauaaucagucaaaugauuccaccauuaaauugauagcaauguuguauacaccacuuagggcuaauaaugcuggggaagaugucuuuacagucucuugucggguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaacuacaaagggagauggcucgacccguggccauaaagcuacaguuuacacugggagcgccccauuuacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuuguaaauccagacacggguaggguccuguuugagugcaaacuucacaaaucaggcuaugucacaguggcucacaccggccagcacgauuuggucaucccccccaauggcuauuuuagguuugauuccuggguuaaucaguucuacacacuugcccccaugggaaauggaacggggcguaggcguuaa

SEQ ID NO: 7148 - RNA, 1617 nt, Artificial Sequence
  VP1__Norovirus_and/or_Norovirus-like__JN400614
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuuuuaucacuauaaucagucaaaugauucuaccauuaaauugauagcaaugcuguauacaccacuuagggcuaauaaugcuggggacgaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugccuccuucacuccaaagcugggcaguguucaauuuaguacugauacagaaaaugauuuugaaacucaccaaaacacaaaauucaccccagucggugucauccaggauggcagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7149 - RNA, 1617 nt, Artificial Sequence
  VP1__Norovirus_and/or_Norovirus-like__JN400601
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugacuaauucaagauuccccauuccuuuggaaaaguuguucacgggucccaguggugccuuuguuguucaaccgcaaaauggcagaugcacgacugauggcgugcuccuaggcaccacccaacugucuccugucaacaucugcaccuucagaggggaugucacccacauugcagguucucgugacuacacaaugaauuuggcuucucuaaauuggaacaauuaugacccaacagaagaaauuccagccccucuaggaacuccagauuucgugggaaagauccaaggugugcucacucaaaccacaaagggaaauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuauaucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7150 - RNA, 1617 nt, Artificial Sequence
  VP1__Norovirus_and/or_Norovirus-like__JQ613538
augaagauggcgucgagugacgccaacccaucugauggguccacagccaaccucgucccagaggucaauaaugagguuauggcuuuggagcccguuguuggugccgccauugcggcaccuguagcgggccaacaaaauauaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuacgcaggugguuuugaagugcagguaauccucgcggggaacgcguucaccgccgggaaaaucguauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcacuuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagccacaguguacacugggagcgccgaauuuuccccaaaacuggguagaauucaauuugccacugacacaaacaaugauuuugaugcuaaccaaaacacaaaguucaccccagucggugucauccaggauggugguacuacccaccgaaaugaaccccaacaaugggugcuuccaaguuacucaggcagaaauacucauaaugugcaccuggcccccgcuguagcccccacuuuuccgggugagcagcuccucuucuucagaucuacccugcccggaugcaguggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuauuccccccaaugguuauuuuagauuugauuccugggucaaccaguucuacacacuugcccccaugggaaaugggacggggcguagacguuaa

SEQ ID NO: 7151 - RNA, 1617 nt, Artificial Sequence
  VP1__Norovirus_and/or_Norovirus-like__HM802543
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuaggaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuucuaucauuacaaucaaucaaaugacccuaccaucaaauugauagcaauguuguauacaccacuuagggcuaacaaugcuggggacgaugucuuuacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcuuuuaggcacuacccaauugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaagauccaaggcgugcucacccaaaccacaaggagggacggcucgacccgcggucacaaagccacaguaagcacuggaaguguccacuucaccccaaagcugggcaguguucaauucucuacugauacaagcaaugacuuugaaacuggccaaaacacgagauucaccccagucggugucguccaggauggugacaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7152 - RNA, 1617 nt, Artificial Sequence
  VP1__Norovirus_and/or_Norovirus-like__AB541337
augaagauggcgucgaaugacgccaacccaucugauggguccgcagccaaccucgucccagaggucaacaaugagguuauggcuuuggagcccguugucggugccgcuauugcggcgccuguagcgggccaaacaaacguaauugaccccuggauuagaaauaauuuuguacaagccccugguggagaguucacagugucccccagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuagacaauuggaaccuguguugauccccuuaccugacguuaggaauaauuucuaucacuauaaucagucaaaugauuccaccauuaaacugauagcaaugcuguauacaccacuuagggccaauaacgcuggggaagaugucuucacagucucuugucgaguccucacgaggccauccccugauuuugauuuuauauuuuuggugccacccacaguugagucaagaacuaaaccauuuacugucccaaucuuaacuguugaagagaugaccaauucaagauuccccaucccuuuggaaaaguuguucacgggucccagcggugccuuugucguucaaccacaaaauggcaggugcacgacugauggcgugcucuuaggcaccacccaacugucuccugucaacaucugcaccuucagaggggaugucacccacauugcagguucucgugauuauacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcagcguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguucauaauguacaccuagccccugcuguggcccccacuuuuccgggugaacaacuucuuuucuucagguccacuaugcccggaugcagcggguaucccaacauggauuuggauugccuacucccucaggagugggugcaacacuucuaccaagaggcagcuccagcacaaucugauguggcuuuauugagauuugugaauccagacacggguaggguccuguuugagugcaaacuucauaaaucaggcuaugucacaguggcucacaccggccagcacgauuuggucaucccccccaauggcuauuuuagguucgauuccuggguuaaucaauucuacacacuugcccccaugggaaauggaacggggcguagacguuaa

SEQ ID NO: 7153 - RNA, 1617 nt, Artificial Sequence
  VP1__Norovirus_and/or_Norovirus-like__AB541252
augaagauggcgucgaaugacgccaacccaucugauggguccgcagccaaccucgucccagaggucaacaaugaggucauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaugaugucuucacagucuccugucgaguccucacgaggccauccccugauuuugacuuuauauuuuuggugccaccuacaguugagucaagaacuaagccauuuacugucccaaucuuaacuguugaagaaaugaccaauucaagauuccccauuccuuuggaaaaauuguucacgggucccagcagugccuuuauuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaaguugggcaguguucaauuugguacugauacagaaaacgauuuugaaacucaccaaaacacaaaauucaccccagucggugucauccaggaugguagcaccacccaccgaaaugaaccccaacaaugggugcucccaaguuauucaggcagaaauguccauaauguacaccuagccccugcuguagcccccaauuucccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccugacacggguaggguccuguuugagugcaaacuucauaaaucaggcuaugucacaguggcucacaccggucaacaugauuuggucaucccccccaauggcuacuuuagguuugacuccuggguuaaucaauucuacacacuugcccccaugggaaauggaacggggcguagacguuaa

SEQ ID NO: 7154 - RNA, 1617 nt, Artificial Sequence
  VP1__Norovirus_and/or_Norovirus-like__GU270580
augaagauggcgucgaaugacgccaccccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuagguccugauuugaaccccuaccuuucccauuuggccagaauguacaaugguuaugcaggugguuuugaagugcagguaauccucgcggggaacgcguucaccgccggaaaaaucauauuugcagcagucccaccaaacuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuuuauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugauggcgugcuccuagguacuacccaacugucuccugucaacaucugcaccuucagaggggaugucacccauauugcagguagucguaacuacacaaugaauuuggcuacucaaaacuggaacaguuaugacccaacagaagaaaucccagccccucuaggaacuccagauuucguggggaagauucaaggugugcucacccaaaccacaagggcagacggcucgacccgcggccacaaagcuacaguguacacugggagcgccgauuuuucuccaaaacuggguagaauucaguuugccacugacacagacaaugauuuugaugcuaaccaaaacacaaaguucaccccagucggugucauccaggaugguaauacugcccaucgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugccugcucccccaggaaugggugcaguauuucuaucaagaggcagccccagcacaaucugauguggcucugcuaagauuugugaauccagacacagguaggguuuuguuugaguguaagcuucauaaaacaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7155 - RNA, 1617 nt, Artificial Sequence
  VP1__Norovirus_and/or_Norovirus-like__EU876882
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaacuuuguacaagccccugguggagaguucacaguguccccuagaaaugcuccaggugagauacuauggagugcgcccuugggcccugauuugaacccuuaccuuucucaucuggccagaauguacaaugguuaugcaggugguuuugaagugcagguaauccuugcggggaacgcguucaccgccggaaaaaucauauuugcagcagucccaccuaacuuuccaacugaaggcuugagccccagccagguuaccauguucccccauauaauaguagauguuaggcaauuggaaccuguguugauccccuuaccugauguuaggaauaauuuuuaucacuacaaccaaucaaaugacccuaccauuaaauugauagcaaugcuguacacaccacuuagggcuaauaaugcuggggaugaugucuucacagucucuugucgaguccucacgagaccauccccugauuuugauuuuauauuuuugguacccccaacaguugaaucaagaaccaaaccauucaccgucccaaucuuaacuguugaggaaaugaccaauucaagauuccccauuccuuuggaaagguuguacacgggucccagcagugcuuuuguuguccagccacaaaacggcaggugcacgacugauggcgugcucuuaggcaccacccagcugucugcugucaacaucugcaccuuuagaggagaugucacccauauugcaggcucucgcaauuauacaaugaauuuggccucucaaaauuggaauaacuaugauccaacagaagaaaucccagccccccugggcaccccagacuucgugggaaagauccaaggcaugcucacccaaacuacaagaagugauggcucgacccgcggccacaaggccacagugcucacugggagugccgacuuugccccaaaguugggcagaguccaauucgccaccgacacagacaacgauuucgaaucuggccaaaacacgaaauucaccccagucggcgucauccaggaugguuccaccacccaccgaaaugaaccccaacaauggguacucccaaauuacucagguagaacuggucauaaugugcaccuagccccugcaguugcccccacuuacccgggugagcaacuccuuuucuucagguccacuaugcccggauguagcggguaccccaacauggaucuagauugcuugcuuccccaggaaugggugcagcacuucuaccaagaagcagcuccagcacaaucugauguagcucugcuaagauuugugaauccagacacaggcaggguucuauuugagugcaagcuccauaaaucaggauaugucacaguggcucauacuggucagcaugauuugguuauucccccuaaugguuauuuuagauuugauuccugggucaaccaguuuuacacacuugcccccaugggaaauggagcggggcguagacguuaa

SEQ ID NO: 7156 - RNA, 1617 nt, Artificial Sequence
  VP1__Norovirus_and/or_Norovirus-like__AB933649
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccugucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucagaccacgaagggagauggcucgacccguggucauaaagcuacaguuuacacugggagugcccccuucacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguggaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacguuaa

SEQ ID NO: 7157 - RNA, 1617 nt, Artificial Sequence
  VP1__Norovirus_and/or_Norovirus-like__JX439816
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaauucacaguauccccuaggaacgcuccaggugaaauacuguggagcgcgccccuaggcccugauuugaauccuuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuucacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuuucuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucagguagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuucagauuugauuccugggucaaccaguucuacacacuugcccccaugggaaauggaacggggcguagacguuaa

SEQ ID NO: 7158 - RNA, 1617 nt, Artificial Sequence
  VP1__Norovirus_and/or_Norovirus-like__JX155739
augaagauggcgucgaaugacgccaacccaucugauggguccgcagccaaccucgucccagaggucaacaaugagguuauggcuuuggagcccguugucggugccgcuauugcggcgccuguagcgggccagcaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcuggaaaaauuauauuugcagcagucccaccaaauuucccaacugaaggcuugagucccagccaggucacuauguucccucacauaauaguggauguuaggcaguuggaaccuguguugauccccuuaccugauguuaggaauaacuucuaucacuacaaucagucaaaugauucuaccauuaaauugauagcaaugcuauauacaccacuuagggcuaacaaugcuggggaugaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcagugccuucguuguucaaccacaaaauggcagaugcacgacugauggcgugcucuuaggcaccacccaauugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaaggugugcucacucaaaccacaaagggagaugguucgacccguggccauaaagccacaguuuacacugggagugcccccuuuacuccaaagcuggguaguguucaguucaguacagauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguauccuaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuacgucacaguggcucacaccggucagcaugauuuggucaucccccccaaugguuauuuuagguuugauuccuggguaaaucaauucuacacacuugcccccaugggaaauggaacggggcgcagacguuaa

SEQ ID NO: 7159 - RNA, 1617 nt, Artificial Sequence
  VP1__Norovirus_and/or_Norovirus-like__HQ456338
augaagauggcgucgaaugacgccagcccaucugauggguccgcagccaaccucgucccagaggucaacaaugagguuauggcuuuggagcccguugucggugccgcaauugcggcgccuguagcgggccaaaaaaauguaauugaccccuggauuagaaauaauuuuguacaagccccugguggagaauucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggcgccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggccauaaagcuacaguuuauacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccgaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7160 - RNA, 1617 nt, Artificial Sequence
  VP1__Norovirus_and/or_Norovirus-like__AB541359
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccagucuuaacuguugaagaaaugaccaauucaagauuccccauuccuuuggaaaaguuguucacggguccuagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugaaguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccugggucaaucaauucuacacacuugccccuaugggaaauggaacggggcguagacguuaa

SEQ ID NO: 7161 - RNA, 1617 nt, Artificial Sequence
  VP1__Norovirus_and/or_Norovirus-like__AB541280
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcagccuuaggcccugaucugaaucccuaucuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7162 - RNA, 1617 nt, Artificial Sequence
  VP1__Norovirus_and/or_Norovirus-like__AB541244
augaagauggcgucgaaugacgccaacccaucugauggguccgcagccaaccucgucccagaggucaacaaugaggguauggcuuuggagcccguugucggugccgcuauugcggcgccuguagcgggccaaacaaauguaauugaccccuggauuagaaauaauuuuguacaagccccugguggagaguucacaguauccccuagaaacgcucccagugaaauacuauggagcgcguccuuagguccugaucugaaucccuaccuaucucauuuggccagaauguauaaugguuaugcaggugguuuugaagugcaggugauccucgcggggaacgcguucaccgccgggaaaauuauauuugcagcaguuccaccaaauuuuccaacugaaggcuugagucccagccaggucacuauguucccccacauaauaguagauguuaggcaauuggaaccuguguugauccccuuaccugauguuaggaauaacuucuaucacuacaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggaaauggcucgacccguggccauaaagccacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaguguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccugggucaaucaauucuacacacuugcccccaugggaaauggaacggggcguagacguuaa

SEQ ID NO: 7163 - RNA, 1617 nt, Artificial Sequence
  VP1__Norovirus_and/or_Norovirus-like__AB541203
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcacuacccaacugucuccugucaacaucugcaccuucagaggggaugucacccacauuguagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaucgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacguuaa

SEQ ID NO: 7164 - RNA, 1617 nt, Artificial Sequence
  VP1__Norovirus_and/or_Norovirus-like__GQ850882
augaagauggcgucgaaugacgccaacccaucugauggguccacagccaaccucgucccagaggucaacaaugagguuauggcuuuggaacccguuguaggugccgcuauugcggcgccuguagcgggccaacaaaauguaauugaccccuggauuagaaauaauuuuguacaagccccugguggagaguuuacaguguccccuagaaaugcuccaggugagauacuauggagugcgcccuugggcccugauuugaacccuuaccuuucucaucuggccagaauguauaaugguuaugcagguggcuuugaagugcagguaauccuugcggggaacgcguucaccgccggaaaaaucauauuugcagcaguuccaccuaacuuuccaacugaaggcuugagccccagccagguuacuauguucccccauauaauaguagauguuaggcaauuggaaccuguguugauccccuuaccugauguuagaaauaacuucuaucacuacaaccaaucaaaugacccuaccauuaaauugauagcaaugcuguacacaccacuuagggcuaauaaugcuggggaugaugucuucacagucuccugucgaguccucacgagaccauccccugacuuugacuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuaggcaccacccagcugucugcugucaacaucugcaccuuuagaggggaugucacccacauugcaggcucucgcaauuauacaaugaauuuggccucucaaaauuggaauaacuaugauccaacagaagaaaucccagccccccuaggcaccccagauuucgugggaaagauucaaggcaugcucacccaaaccacaagaagugacggcucgacccgcggccacaaggccacaguguucacugggagugccgacuucgccccaaaauugggcagaguccaauucgccacugacacagacaacgauuucgaaucuggccaaaacacgaaauucaccccaguuggcgucauccaggaugguuccacuacccaccgaaaugaaccucaacaauggguacucccaaauuacucagguagaacuggucauaaugugcaucuagccccugcugucgccccuacuuacccgggugagcaacuccuuuucuucagguccacuaugcccggauguagcggguaccccaacauggaucuagauugcuugcucccccaggagugggugcagcacuucuaccaagaagcagcuccagcacagucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacuugcccccaugggaaauggaacggggcguagacguuaa

SEQ ID NO: 7165 - RNA, 1617 nt, Artificial Sequence
  VP1__Norovirus_and/or_Norovirus-like__KR131772
augaagauggcgucgaaugacgccaccccaucugauggguccacagccaaccucgucccagaggucaacaaugagguuauggcuuuggagcccguuguuggugccgccauugcggcaccuguagcgggccaacaaaauguaauugaccccuggauuaggaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgcuggaaaaaucauauuugcagcagucccaccaaacuucccaacugaaggcuugagccccagccaggucacuauguucccccacauaauaguagauguuaggcaacuggaaccuguguugauccccuuacccgauguuaggaauaauuuuuaucacuacaaucaaucaaaugaccccacuaucaaauugauagcaauguuguauacaccacuuagggcuaauaaugcuggggacgaugucuucacaguuucuugucggguucucacgagaccaucccccgauuuugauuuuauauuuuuagugccacccacaguugagucaagaacuaaaccauucuccgucccaauuuuaacuguugaggagaugaccaauucaagauuccccauuccuuuggaaaaguuguucacgggccccagcagugccuuuguuguucaaccacaaaacggcaggugcacaacugauggcgugcuccuagguacuacccaacugucuccugucaacaucugcaccuucagaggggaugucacccauauuacagguagucguaacuacacaaugaauuuggcuacucaaaacuggaacaguuaugacccaacagaagaaaucccagccccucuaggaacuccagauuuuguggggaagauucaaggugugcucacccaaaccacaagggcagauggcucgacccgcggccacaaagcuacaguguacacugggagcgccgauuuugcuccaaaacuggguagaguucaguuugccacugacacagacaaugauuuugaugccaaccaaaacacaaaguucaccccagucggugucauccaggaugguaacacugcccaccgaaaugaaccccaacaaugggugcucccaaguuacucaggcagaaauagucacaaugugcaccuggcccccgcuguagcccccacuuuuccgggugagcaacuucucuuuuucagaucuacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7166 - RNA, 1617 nt, Artificial Sequence
  VP1__Norovirus_and/or_Norovirus-like__KR904215
augaagauggcgucgagugacgccaacccaucugaugggucugcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuaggaacgcuccaggugaaauacuauggagcgcgcccuuaggcccugaucuaaaucccuaccuaucccacuuggccagaauguacaaugguuaugcaggugguuuugaagugcaggugauccucgcggggaacgcguucaccgccgggaagaucauauuugcagcagucccaccaaauuucccaacugaaggcuugagccccagccaggucacuauguucccccauauaauaguagauguuaggcaacuagaacccguguugauucccuuacccgauguuaggaacaauuucuaccauuacaaucaaucaaaugaccccacuauuaaguugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugacggcgugcuccuagguacuacccaacugucuccugucaacaucugcaccuucagaggggaugucacccauacuacagguagucacaacuacacaaugaauuuggccacucaaaauuggagcaguuaugacccaacagaagaaaucccagccccucuaggaacuccagauuucguggggaagauucaagguguacucacccaaaccacaaagacagauggcucgacacgcggccacaaagcuacaguguacacugggagcgccgacuuugcuccaaaauuggguagaguucaauuugccacugacacagacaaugauuuugaagcuaaccaaaacacaaaguucaccccagucggugucauccaggaugguaauacugcccaccgaaaugaaccccaacagugggugcucccaaguuacucaggcagaaauacucacaaugugcauuuggcccccgcuguagcccccacuuuuccgggugagcaacuucucuuuuucagauccacuaugcccggaugcagcggguaucccaacauggauuuggacugucugcucccccaggaaugggugcaguacuucuaccaagaggcagccccagcacaaucugauguggcucuacuaagauuugugaacccagacacagguaggguuuuguuugaguguaagcuucauaaaucaggcuauguuacaguggcucacacugguccacaugauuugguuaucccccccaaugguuauuuuagauuugauuccugggucaaccaguuuuacacacuugcccccaugggaaaugggacggggcgcagacgauaa

SEQ ID NO: 7167 - RNA, 1617 nt, Artificial Sequence
  VP1__Norovirus_and/or_Norovirus-like__AB933715
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccauauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccgcggccauaaagcuacaguuuacacugggagugcccccuucacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagcccccgcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuugugaauccagacacggguaggguucuuuuugagugcaaacuucacaaaucaggcuaugucacaguggcucacaccggccagcaugauuuggucaucccccccaauggcuauuuuagguuugauuccuggguuaaucaguucuacacacuugcccccaugggaaauggaacggggcguagacguuaa

SEQ ID NO: 7168 - RNA, 1617 nt, Artificial Sequence
  VP1__Norovirus_and/or_Norovirus-like__AB933695
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcagguucucauaauuacacaaugaguuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuacucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaagucaggcuaugucacaguggcucacaccggccagcaugauuuggucaucccccccaaugguuauuuuagguuugauuccuggguuaaucaguucuacacacuugcccccaugggaaauggaacggggcguagacguuaa

SEQ ID NO: 7169 - RNA, 1617 nt, Artificial Sequence
  VP1__Norovirus_and/or_Norovirus-like__AB933681
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuucccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacaucugcaccuucagaggggaugucacccacauugcagguucucgugauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacgcaaaguucaccccggucggugucauccaggaugguagcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccugcucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacguuaa

SEQ ID NO: 7170 - RNA, 1617 nt, Artificial Sequence
  VP1__Norovirus_and/or_Norovirus-like__AB933675
augaagauggcgucgaaugacgccaacccaucugauggguccgcagccaaccucgucccagaggucaacaaugagguuauggcuuuggagcccguugucggugccgcuauugcggcgccuguagcgggccaacagaaugugauugaccccuggauuagaaauaauuuuguacaagccccugguggagaguucacaguauccccuagaaaugcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccacauaauaguggauguuaggcaauuggaaccuguguugauccccuuaccugacguuaggaauaauuucuaccacuauaaucagucaaaugauucuacuauuaaauugauagcaaugcuguauacaccacuuagggcuaauaaugcuggggaggaugucuucacagucucuugucgaguccucacgagaccauccccugauuuugauuuuauauuuuuggugccaccuacaguugagucaagaacuaaaccauuuacugucccagucuuaacuguugaagaaaugaccaauucaagauuucccauuccuuuggaaaaguuguuuacgggucccagcagugccuuuguuguucaaccacaaaauggcagaugcacgacugauggcgugcucuuaggcaccacccaacugucuccugucaacaucugcaccuucagaggggaugucacccacauugcaaauucucacaauuacacaaugaauuuggcuucucuaaauuggaacaauuaugacccaacagaagaaauuccagccccucuaggaaccccagauuucgugggaaagauccaaggugugcucacucaaaccacaaagggagaugguucgacccguggccauaaagcuacaguuuacacugggagugcccccuuuacuccaaagcuaggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacguuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugaguguaagcuucauaaaucaggcuaugucacaguagcucacaccggccagcaugauuuggucaucccccccaaugguuauuuuagguuugauuccuggguuaaucaauucuacacacuugcccccaugggaaauggaacggggcguagacguuaa

SEQ ID NO: 7171 - RNA, 1617 nt, Artificial Sequence
  VP1__Norovirus_and/or_Norovirus-like__AB933652
augaagauggcgucgaaugacgccaacccaucugauggguccgcagccaaccucgucccggaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaauuucuaccauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcaguaccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuuguaaauccagacacggguaggguucuguuugagugcaaacuucacaaaucaggcuaugucacaguggcucacaccggccagcaugauuuggucaucccccccaauggcuauuucagguuugauuccuggguuaaucaguucuacacacuugcccccaugggaaauggaacggggcguagacguuaa

SEQ ID NO: 7172 - RNA, 1617 nt, Artificial Sequence
  VP1__Norovirus_and/or_Norovirus-like__KF429762
augaagauggcgucgaaugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaccauuauaaucagucaaaugauucuacuauuaaauugauagcaaugcuguauacaccacuuagggcuaauaaugcuggggaugaugucuuuacaguuucuugucgaguucucacgagaccaucccccgauuuugauuucauauuuuuagugccaccuacaguugaaucaagaacuaaaccauucucugucccaauuuuaacuguugaagaaaugaccaauucaagguuccccauuccuuuggaaaaguuguucacgggccccaguaguaccuuuguuguucaaccacaaaacggcaggugcacgacugauggcgugcuccuagguaccacccaacugucuccugucaacaucugcaccuucagaggggaugucacccacauuacaggcagucguaacuacacaaugaaccuggcuucccaaaauuggaacaguuaugacccaacagaagaaaucccagccccucuaggaacuccagauuucguggggaagauucaaggugugcucacucaaaccacaaggacagauggcucgacccgcggccacaaagcuacaguguacacugggagcgccgacuuuucuccaaaacuggguagaguucaauuugccacugacacagacaaugauuucgaugcuaaccaaaacacuaaguucaccccagucgguguuauccaggaugguggcacuacccaccgaaaugaaccccaacaaugggugcucccaaguuacucaggcagaaacacucauaaugugcaccuggcccccgcuguagcccccacuuuuccgggugagcaacuccucuucuucagaucuaccaugccaggaugcagcggguaccccaacauggauuuggacugucugcucccccaggaaugggugcagcauuucuaccaggaagcagccccagcacaaucugauguggcucugcuaagauuugugaauccagacacagguaggguucuguuugaguguaagcuucauaaaucaggcuauguuacaguggcucacacuggucaacaugauuugguuaucccccccaaugguuauuuuagauuugauuccugggucaaccaguucuacacacuugccccuaugggaaaugggacggggcguagacguuaa

SEQ ID NO: 7173 - RNA, 1617 nt, Artificial Sequence
  VP1__Norovirus_and/or_Norovirus-like__JX644027
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuacuauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaaaaacuaaaccauuuacugucccaaucuuaacuguugaagaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguagcaccacccaccgaaaugaaccccaacaaugggugcucccaaguuauucagguagaaaugcccagaauguacaccuagccccugcuguagcccccacuuuuccgggugaacaacuucuuuucuuuagguccacuaugcccggaugcagcggguaucccaacauggaucuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7174 - RNA, 1617 nt, Artificial Sequence
  VP1__Norovirus_and/or_Norovirus-like__JN400617
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggggaguucacaguauccccuagaaacgcuccaggugaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucaccauguucccccacauaauaguagauguuaggcaauuggaaccuguguugauccccuuaccugauguuaggaauaacuucuaucauuauaaucagucaaacgauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaauuacacaaugaauuuggcugcucugaauuggaacaauuaugacccaacagaagaaauuccagccccucuaggaaccccagauuucgugggaaagauccaaggugugcuuacucaaaccacaaaggcagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccaccuucccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7175 - RNA, 1617 nt, Artificial Sequence
  VP1__Norovirus_and/or_Norovirus-like__JQ613519
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagaugucaggcaauuggaaccuguguugauccccuugccugauguuaggaacaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuucuagugccacccacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacuguccccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggucauaaagcuacagucuacacugggagugccgacuuuacuccaaagcugggcaguguucaauucaguacugauacagaaaaugauuuugaaacucaccaaaacacaaaauucaccccagucggugucauccaggaugguaacaccacccaccgaaaugaaccccaacaaugggugcucccaaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7176 - RNA, 1617 nt, Artificial Sequence
  VP1__Norovirus_and/or_Norovirus-like__HQ456341
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaagcaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggagacgaugucuucacaguuucuugucggguucucacgagaccaucccccgacuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcguguuccuaggcaccacucaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccauaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucauaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugagugcaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7177 - RNA, 1617 nt, Artificial Sequence
  VP1__Norovirus_and/or_Norovirus-like__HM802540
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcuuuuagguacuacccagcugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaagauccaaggcgugcucacccaaaccacaaggagggacggcucgacccgcggucacaaagccacaguaagcacuggaaguguccacuucaccccaaagcugggcaguguccaacucucuacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7178 - RNA, 1617 nt, Artificial Sequence
  VP1__Norovirus_and/or_Norovirus-like__AB541257
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugacacagaaaaugauuuugaagcucaccaaaacacaaaauucaccccagucggugucauccaggaugguagcaccacccaccgaaaugaaccccaacaaugggugcucccaaguuauucagguagaaaugcucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacguuaa

SEQ ID NO: 7179 - RNA, 1617 nt, Artificial Sequence
  VP1__Norovirus_and/or_Norovirus-like__AB541242
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcauccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacugucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggccucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacguuaa

SEQ ID NO: 7180 - RNA, 1617 nt, Artificial Sequence
  VP1__Norovirus_and/or_Norovirus-like__AB541225
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauauuauggagcgcgcccuuaggcccugaccugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagccaggucacuauguucccccacauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuucacagucucuugucgaguucucacgagaccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuacacugggagugcccccuuuacuccaaagcugggcaguguucaauucaguacugauacaggagaugauuuucaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugagugcaaacuucauaaagcaggcuaugucacaguggcucacaccggccagcacgauuuggucaucccccccaaugguuacuuuagguuugauuccuggguuaaucaauucuacacacuugcccccaugggaaauggaacggggcguagacguuaa

SEQ ID NO: 7181 - RNA, 1617 nt, Artificial Sequence
  VP1__Norovirus_and/or_Norovirus-like__AB541190
augaagauggcgucgaaugacgccaacccaucugauggguccacagccaaccucgucccagaggucaacaaugagguaauggcuuuggagcccguuguaggugccgcuauugcggcgccuguagcgggccaacaaaauguaauugaccccuggauuagaaauaauuuuguacaagccccugguggagaguuuacagugucccccagaaaugcuccaggugagauacuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcaguuccaccuaacuuuccaacugaaggcuugagcccuagccagguuacuauguucccccauauaauaguagauguuaggcaauuggaaccuguguugauccccuuaccugauguuaggaauaacuucuaucacuacaaccagucaaaugacccuaccauuaaauugauagcaauguuguacacaccacuuagggccaauaaugcuggggaugaugucuucacagucucuugucgaguccucacgagaccauccccugacuuugacuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuagguaccacccagcugucugcugucaacaucugcaccuuuagaggggaugucacucacauugcaggcucucgcaauuauacaaugaauuuggccucucaaaauuggaacaacuaugauccaacagaagaaaucccagccccccugggcaccccagauuucgugggaaagauccaaggcaugcucacccaaaccacaagaagugauggcucgacccgcggccacaaggccacagugcucacugggagugccgacuucgccccaaaauugggcagaguucaauucgccacugacacagacaacgauuucgaaucuggccaaaacacgaaauucaccccaguuggcgucauccaggauggcuccacuacccaccgaaaugaaccucaacaauggguacucccaaauuacucagguagaacuggucauaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauauggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacucgcccccaugggaaaugggacggggcguagacguuaa

SEQ ID NO: 7182 - RNA, 1617 nt, Artificial Sequence
  VP1__Norovirus_and/or_Norovirus-like__AB492092
augaagauggcgucgaaugacgccaccccaucugauggguccacagccaaccuugucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuuaggcccugauuugaaucccuaccucucccauuuggccagaauguauaaugguuaugcaggugguuucgaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauucccuuacccgauguuaggaauaauuucuaccacuacaaucaaucaaaugaccccaccaucaaauugauagcaauguuguacacaccacuuagggcuaauaaugcuggggacgaugucuucacaguuucuugucggguucucacgagaccauccccugauuuugauuuuauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugauggcgugcuccuagguacuacccaacugucuccugucaauaucugcaccuucagaggggaugucacccauauuucagguagucguaacuacacaaugaauuuggcgacucaaaauuggaacaguuaugacccaacagaagaaaucccagccccucuaggaacuccagauuuuguggggaagauccaaggugugcucacccaaaccacaagggcagauggcucgacccgcggccacaaggcuacaguguacacugggagcgccgauuuugcuccaaaacuggguagaguucaauuugccacugacacagacaaugauuuugaugcuaaccaaaacacaaaguucaccccagucggugucauccaggaugguaacacugcccaccgaaaugaaccccaacaaugggugcucccaaguuacucaggcagaaauagucacaaugugcaccuggcccccgcuguagcccccacuuuuccgggugagcaacuucucuucuucagaucuacuaugcccggauguagcggguaccccaacauggauuuggacugucugcucccccaggaaugggugcaguauuucuaucaagaggcagccccagcacaaucugauguggcucugcuaagauuugugaauccagacacaggcaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaaugggacggggcguagacguuaa

SEQ ID NO: 7183 - RNA, 1617 nt, Artificial Sequence
  VP1__Norovirus_and/or_Norovirus-like__EU916956
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaauggcuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauuuucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgaaauuuaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcucacacuggucaacaugauuugguuaucccccccaauggcuauuuuagauuugauuccugggucaaccaauucuacacacuugcccccaugggaaauggagcggggcguagacguuaa

SEQ ID NO: 7184 - RNA, 1617 nt, Artificial Sequence
  VP1__Norovirus_and/or_Norovirus-like__EF126962
augaagauggcgucgaaugacgccaccccaucugaugggucuacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggggaguuuacaguauccccuagaaacgcuccaggugaaauauuauggagcgcacccuugggcccugauuugaaucccuaccuuucccauuuggccagaauguauaaugguuaugcaggugguuuugaagugcagguaauccucgcggggaacgcguucaccgccggaaaaaucauauuugcagcagucccaccaaauuucccaacugaaggcuugagcccuagccaggucacuauguucccccauauaauaguagauguuaggcagcuggaaccuguguugaucccccugccugauguuaggaacaauuucuaucauuacaaccaaucaaaugaccccaccaucagauugauagcaaugcuguacacaccacuuagggcuaacaaugcuggggacgaugucuucacagucucuugucgaguucucacgagaccaucccccgauuuugauuucauauuucuggugccacccacaguugagucaagaaccaaaccauucucugucccaaucuuaacuguugaggagaugaccaauucaagauucccuauuccuuuggaaaaguuguucacgggccccagcagugccuuuguuguucaaccacaaaauggcagaugcacgacugauggcgugcucuuagguacuacccagcugucuccugucaacaucugcaccuuuagaggggaugucacccacauugcagguacucaaaauuacacaaugaaucuggccucccaaaauuggaacaauuaugacccaacagaagaagucccagccccucugggaaccccagauuuuguaggaaagauccaaggcgugcucacccaaaccacaaggggggauggcucgacccguggucauaaagccacagugagcacuggaaguguccacuuuaccccaaagcugggcaguguucaauucuccaccgauacaagcaaugacuuugaaacuggccaaaacacgagauucaccccagucggugucguccaggaugguaguaccacccaccaaaaugaaccccaacaaugggugcucccagauuauucagguagagauaaucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaacccagacacagguagaguuuuguuugagugcaagcuucauaagucaggcuauguaacaguggcccacacuggccaacaugauuugguuauuccccccaauggcuauuuuagauuugauucuugggucaaccaguucuacacacuugcccccaugggaaauggagcggggcguagacguuaa

SEQ ID NO: 7185 - RNA, 1617 nt, Artificial Sequence
  VP1__Norovirus_and/or_Norovirus-like__AB663687
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaagguuugagucccagccagguuacuauguucccccacauaauaguagauguuaggcaauuggaaccuguguugaucccuuuaccugauguuaggaauaacuucuaccacuauaaucagucaaaugauucuaccauuaaauugauagcaaugcuguacacaccacuuagggccaauaaugcuggggaugaugucuucacagucucuugucgaguccucacgagaccauccccugauuuugauuuuauauuucuggugccacccacaguugagucaagaaccaagccauuuacugucccaaucuuaacuguugaagaaaugaccaauucaagauuccccauuccuuuggaaaaacuguucacgggucccagcagugccuuuguuguucaaccacaaaauggcagaugcacuacugauggcgugcucuuaggcaccacccaacugucuccugucaacaucugcaccuucagaggagaugucacccacauugcggguucccgcaauuacacaaugaauuuggccucucuaaauuggaacaauuacgacccaacagaagaaauuccagccccccugggaacuccagauuuugugggaaagauccaaggugugcucacucaaaccacaaagggagacggcucgacccggggccauaaagcuacaguuuacacugggagugccgacuuuacuccaaagcugggcaguguccaauuugguacugauacagaaaaugacuuugaaacucaccaaaacacaaaauucaccccaguaggugucauccaggaugguagcaccacccaccgaaaugaaccccaacaaugggugcucccaaguuauucagguagaaauguccauaauguacaccuagccccugcuguagcucccaauuuuccgggugaacaauuucuuuucuucagguccacuaugcccggauguagcggguaucccaacauggauuuggauugccugcucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccaacaugauuuggucaucccccccaauggcuauuuuagguuugauuccuggguuaaccaauucuacacacuugcccccaugggaaauggaacggggcguagacguuaa

SEQ ID NO: 7186 - RNA, 1617 nt, Artificial Sequence
  VP1__Norovirus_and/or_Norovirus-like__AB933759
augaagauggcgucgagugacgccaacccaucugaugggucuacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuaggaacgcuccaggugaaauacuauggagcgcgccccuaggcccugauuugaauccuuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuucacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucagguagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuuuagauuugauuccugggucaaccaguucuacacacuugcccccaugggaaauggaacggggcguagacguuaa

SEQ ID NO: 7187 - RNA, 1617 nt, Artificial Sequence
  VP1__Norovirus_and/or_Norovirus-like__AB933755
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaacuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuuucagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccauaaaguugauagcgauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaagcuguucacgggccccaguaguaccuuuguuguucaaccacaaaacggcaggugcacgacugauggcgugcuccuagguaccacccaacugucuccugucaacaucugcaccuucagaggggaugucacccauauuacaggcagucauaacuauacaaugaaucuggcuucccaaaauuggaacaguuaugacccaacagaagagaucccagccccucuagggacuccagauuucguggggaagauucaaggcgugcucacccaaaccacaaggacggauggcucgacccgcggccacaaagcuacaguguacacugggagcgccgaauuuuccccaaaacuggguagaguucaauuugccacugacacaaacaaugauuuugaugccaaccaaaacacaaaguucaccccagucgguguuauccaggauggugguacuacccaccgaaaugaaccccaacaaugggugcuuccaaguuacucaggcagaaauacucacaaugugcaccuggcccccgcuguagcccccacuuuuccgggugagcagcuccucuuuuucaggucuaccaugcccggaugcagcggguaccccaacauggauuuggacugucuacucccccaggaaugggugcagcauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7188 - RNA, 1617 nt, Artificial Sequence
  VP1__Norovirus_and/or_Norovirus-like__AB933677
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaggugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuuuagaggggaugucacccacauugcaaguucucguaauuacacaaugaauuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggauggugguaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacguuaa

SEQ ID NO: 7189 - RNA, 1617 nt, Artificial Sequence
  VP1__Norovirus_and/or_Norovirus-like__AB933650
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccugucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucagaccacgaagggagauggcucgacccguggucauaaagcuacaguuuacacugggagugcccccuucacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacguuaa

SEQ ID NO: 7190 - RNA, 1617 nt, Artificial Sequence
  VP1__Norovirus_and/or_Norovirus-like__KM245071
augaagauggcgucgaaugacgccagcccaucugauggguccgcagccaaccucgucccagaggucaacaaugagguuauggcuuuggagcccguugucggugccgcaauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauucacugucccaaucuuaacuguugaagaaaugacuaauucaagauuccccauuccuuuggaaaaguuguucacgggucccagcggcgccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggccauaaagcuacaguuuauacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccgaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7191 - RNA, 1617 nt, Artificial Sequence
  VP1__Norovirus_and/or_Norovirus-like__KF712497
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaaucauauuugcagcaguuccaccaaauuuuccaacugaaggcuugagucccagccaaguuacuauguucccccacauaauaguagauguuaggcaauuggaaccuguguugauccccuuaccugauguuaggaauaacuucuaucacuauaaccagucaaaugauucuaccauuaaauugauagcaaugcuguacacaccacucagagccaauaaugccggggaugaugucuucacggucucuugucgaguccucacgaggccauccccugauuuugacuucauauuucuggugccaccuacaguugagucaagaacuaagccauuuacugucccaaucuugacuguugaagaaaugaccaauucaagauuccccauuccuuuggagaaauuguucacgggucccagcagugccuuuguuguucaaccacaaaauggcagaugcacaacugauggcgugcucuuaggcaccacccaacugucuccugucaacaucugcaccuucagaggggaugucacccacauugcggguucccguaauuacacaaugaauuuggccucucuaaauuggagcaauuacgacccaacagaagagauuccagccccucugggaacuccagauuucgugggaaagauccaaggugugcucacucaaaccacaaagggagauggcucgacccggggccauaaagcuacaguuuacacugggagugccgacuucacuccaaagcugggcaguauucaauuugcuacugauacagaaaaugacuuugaaacucaccaaaacacaagauucaccccagucggugucauucaggaugguggcaccacccaccgaaaugaaccccaacaaugggugcucccaaguuacucagguagaaauguccauaauguacaccuagccccugcuguagcccccaauuuuccaggugaacagcuccuuuucuucagguccacuaugcccggauguagcggauaucccaacauggauuuggauugccuacucccccaggagugggugcaacacuuuuaccaagaggcagcuccagcacaaucugauguggcucuauugagauuugugaauccagacacggguagggucuuguuugagugcaaacuccauaaaucaggcuaugucacaguggcucauaccggccaacaugauuuggucauuccccccaaugguuauuuuagguuugauuccuggguuaaucaguucuacacacuugcccccaugggaaauggaacggggcguagacguuaa

SEQ ID NO: 7192 - RNA, 1617 nt, Artificial Sequence
  VP1__Norovirus_and/or_Norovirus-like__KC990829
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggaucagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguagauguuaggcaauuggaaccuguguugauucccuuaccugauguuaggaauaacuucuaucacuauaaucagucaaaugauucuaccauuaaauugauagcaaugcuguacacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaauuuuccgggugaacaacuucucuucuucagguccacuaugcccggaugcagcggguaucccaacacggauuuggauugccuacucccccaggagugggugcagcacuucuaccaagaggcagcuccagcacaaucugauguggcucuauugagauuugugaauccagacacggguagggucuuguuugagugcaaacuucauaaaucagguuaugucacaguggcucacaccggccaacaugauuuggucaucccccccaaugguuauuuuagguuugauuccuggguuaaucaauucuauacacucgcccccaugggaaauggaacggggcguagacguuaa

SEQ ID NO: 7193 - RNA, 1617 nt, Artificial Sequence
  VP1__Norovirus_and/or_Norovirus-like__JX439843
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgccccuaggcccugaucugaaucccuaccuaucucauuuggccagaauguauaaugguuaugcagguggcuucgaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaacaacuucuaucauuauaaucagucaaaugauucuaccauuaaauugauagcaaugcuguacacgccgcuuagggcuaauaacgcuggggaagaugucuuuacagucucuugucgaguucucacgaggccauccccugauuuugauuuuauauuuuuagugccaccuacagucgagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugccuccugucaacaucugcaccuucagaggggaugucacccacauugcagguucucguguuuacacaaugaauuuggccucucuaaauuggaacaauuaugacccaacagaagaaauuccagccccucuaggaacuccagacuuugugggaaagauccaaggugugcucacucaaaccacaaaggaagacggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugccccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccagcacaaucugauguggcucuauugagauuugugaauccagacacagguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguaggcguuaa

SEQ ID NO: 7194 - RNA, 1617 nt, Artificial Sequence
  VP1__Norovirus_and/or_Norovirus-like__JX439841
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaaugguuaugcagguggcuucgaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaacaaugcuggggaagaugucuucacagucucuugucgaguucucacaaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggacccagcagugccuuuguuguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggaguacccccuuuacuccaaagcugggcaguguccaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacagguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguaggcguuaa

SEQ ID NO: 7195 - RNA, 1617 nt, Artificial Sequence
  VP1__Norovirus_and/or_Norovirus-like__JX439830
augaagauggggucgaaugacgccaacccaucugauggguccacagccaaccucgucccagaggucaacaaugagguuauggcuuuggagcccguuguuggugccgccauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuucacaguuucuugucggguacucacgagaccaucccccgauuuugauuucauauuucuagugccacccacaguugaaucaagaacuaaaccauucucugucccaauuuuaacuguugaggagaugaccaauucaagauuccccauuccuuuggaaaagcuguucacgggccccagcagugccuuuguuguucaaccacaaaacggcaggugcacgacugauggcgugcuccuggguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggccacaaagcuacaguguacacugggagcgccgacuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggcgagcaacuucucuucuucagauccacuaugcccggaugcagcggguaccccaacauggauuuggacugucugcuuccccaggaaugggugcaguauuucuaucaagaggcagccccagcacaaucugauguggcucugcuaagauuugugaauccagacacagguaggguuuuguuugaguguaagcuucauaaaucaggcuauguuacuguggcucacaccggccaacaugauuugguuaucccccccaaugguuauuucagauuugauuccugggucaaccaguucuacacacuugcccccaugggaaauggaacggggcguagacguuaa

SEQ ID NO: 7196 - RNA, 1617 nt, Artificial Sequence
  VP1__Norovirus_and/or_Norovirus-like__JX439828
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaguccucgcggggaacgcguucaccgccggaaaaaucauauuugcagcagucccaccaaauuucccaacugaaggcuugagccccagccaggucacuauguuuccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugacuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcagaugcacgacugauggcgugcuccuagguaccacucaacugucuccugucaacaucugcaccuucagaggggaugucacccauaucacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugacacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugccugcucccccaggaaugggugcaauauuucuaccaggaggcagccccagcacaaucugauguggcucugcuaagauuugugaauccagacacagguaggguuuuguuugaguguaaacuucauaaaucaggcuauguuacaguggcucacaccggucaacaugauuugguuaucccccccaaugguuauuuuagauuugauuccugggucaaccaguucuacacacuugcccccaugggaaauggaacggggcguagacguuaa

SEQ ID NO: 7197 - RNA, 1617 nt, Artificial Sequence
  VP1__Norovirus_and/or_Norovirus-like__JX445153
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuucuaucauuauaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauuccccauuccuuuggaaaaguuguucacgggucccagcagugccuuuguuguucaaccacaaaauggcagaugcacgacugauggcgugcucuuaggcaccacucaacugucuccuguuaacaucugcaccuucagaggggaugucacccacauugcagguacucaaaacuacacaaugaaucuggccucccaaaauuggaacaauuaugacccaacagaagaaaucccagccccucugggagccccagauuuuguaggaaagauccaaggcgugcucacccaaaccacaaggggggauggcucgacccgcggucacaaagccacagugagcacuggaaguguccacuuuaccccaaagcugggcaguguucaauucucuacugauacaagcaaugaccuugaaacuggccaaaacacgagguucaccccagucggugucguccaggaugguaguaccacccaccaaaaugaaccccaacaaugggugcucccaaacuauucagguagagauagucacaauguacacuuagccccugccguggcccccacuuuuccgggugagcaacuucuuuucuuuagguccacuaugcccggaugcagcggguaucccaacaugaauuuggauugccuacucccccaggagugggugcagcacuucuaucaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaaugguuauuuuagauuugauuccugggucaaccaauucuacacacuugcccccaugggaaauggagcggggcguagacguuaa

SEQ ID NO: 7198 - RNA, 1617 nt, Artificial Sequence
  VP1__Norovirus_and/or_Norovirus-like__JX155754
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucaaucaaaugauccuaccauuaaauugauagcaaugcuguauacaccacuuagggcuaauaaugcuggggaagacgucuucacagucucuugucgaguccucacgaggccauccccugauuuugauuuuauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaaugcacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagauacggguaggguccuauuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7199 - RNA, 1617 nt, Artificial Sequence
  VP1__Norovirus_and/or_Norovirus-like__JN400608
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaauccuuaccuaucucauuuggccagaauguauaaugguuaugcaggugguuuugaagugcaggugauccucgcggggaacgcguucaccgccggaaaaauuauauuugcagcagucccaccaaauuucccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccuuccccugauuuugauuuuauauuuuuggugccaccuacaguugagucaagaacuaaaccauuuacugucccaaucuuaacuguugaagaaaugaccaauucaagauucccuauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucauaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguggaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaacccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7200 - RNA, 1617 nt, Artificial Sequence
  VP1__Norovirus_and/or_Norovirus-like__EF187497
augaagauggcgucgagugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccacuuggccagaauguacaaugguuaugcaggugguuuugaagugcagguaauucucgcggggaacgcguucaccgcuggaaaaauuguauuugcagcagucccaccaaauuucccaacugaaggcuugagccccagccaggucacuauguucccccauauaauaguagauguuaggcaacuggaaccuguguugauccccuuacccgauguuaggaauaauuucuaucauuacaaucaaucaaaugaccccaccaucaaguugauagcaauguuguauacaccacuuagggcuaauaaugcuggggaagaugucuucacaguuucuugucgaguucucacgagaccaucccccgauuuugauuucauauuuuuggugccacccacaguugagucaagaacuaaaccauucucugucccaauuuuaacuguugaggagaugaccaauucaagauuccccauuccuuuggaaaaguuguucacgggucccagcaguaccauuguuguucaaccacaaaauggcagaugcacgacugauggcgugcuccuagguacuacccaacugucuccugucaacaucugcaccuucagaggggaugucacccacauugcaggcacucaagaauacacaaugaaucuggccucccaaaacuggaacaauuacgacccaacagaagaaaucccagccccucugggaacuccagauuucgugggaaagauccaaggcgugcucacccaaaccacaaggagggauggcucgacccgcggucacaaagcuacagugagcacuggaagugucaacuucaccccaaagcugggcagaauucaauucuccacugauacaagcaaugacuuugaaacuggccaaagcacgagauucaccccagucgguguuguccaggauggcaguaccacccaccaaaaugaaccccaacaaugggugcucccagauuauucagguagggacagucauaauguacaccuagccccugccguggccccuucuuuuccgggcgagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagauacagguaggguucuguuugaguguaagcuucauaagucaggcuauguuacaguggcucacacuggccagcaugauuugguuaucccccccaauggcuauuuuagauuugauuccugggucaaccaguucuacacacuugcccccaugggaaauggaacggggcguagacguuaa

SEQ ID NO: 7201 - RNA, 1617 nt, Artificial Sequence
  VP1__Norovirus_and/or_Norovirus-like__AB668028
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaagugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccuguuaacaucugcaccuucagaggggaugucacccacauugcaggcucucguaauuacacaaugaacuuggcuucccuaaauuggaacaauuaugacccaacagaagaaauuccagccccucuagggacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7202 - RNA, 1617 nt, Artificial Sequence
  VP1__Norovirus_and/or_Norovirus-like__HM802542
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaauaauauuugcagcagucccaccaaauuucccaacugaaggcuugagccccagccaggucacuauguucccccauauaauaguagauguuaggcaacuggaaccuguguugaucccccugccugauguuaggaauaauuucuaccauuacaaucaaucaaaugaccccaccaucaaauugauagcaaugcuguauacaccacuuagggcuaauaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagguucccuauuccuuuggaaaaguuguucacgggucccagcagugccuuuguuguucaaccacaaaauggcagaugcacgacugauggcgugcuuuuagguacuacccaacugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaggauccaaggcgugcucacccaaaccacaaggagggacggcucgacccgcggucacaaagccacaguaagcacuggaaguguccacuucaccccaaagcugggcaguguucaauucucuacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguucuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7203 - RNA, 1617 nt, Artificial Sequence
  VP1__Norovirus_and/or_Norovirus-like__HQ009513
augaagauggcgucgaaugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcggcagucccaccaaauuucccaacugaaggcuugagccccagccaggucacuauguucccccacauaauaguagauguuaggcaacuggaaccuguguugauccccuuacccgauguuaggaauaauuucuaucacuauaaucaaucaaaugaccccaccaucaaauugauagcaauguuguauacaccacuuagggcuaauaaugcuggggacgaugucuucacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggccacaaagcuacaguguacacugggagcgccgacuuugcuccaaaacuggguagaguucaauuugccaccgacacagacaaugauuuugaugcuaaccaaaacacaaaguucaccccagucggugucauccaggaugguaauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggacuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuucagauuugauuccugggucaaccaguucuacacacuugcccccaugggaaauggaacggggcguagacguuaa

SEQ ID NO: 7204 - RNA, 1617 nt, Artificial Sequence
  VP1__Norovirus_and/or_Norovirus-like__AB541322
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccggccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccucaacaaugggugcucccaaguuacucaggcagaaauagucacaaugugcaccuggcccccacuguagcccccacuuuuccgggugagcaacuucucuucuucagauccacuaugcccggaugcagcggguaccccaauauggauuuggacugucugcucccccaggaaugggugcaguauuucuaucaagaggcagccccagcacaaucugauguggcucugcugagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7205 - RNA, 1617 nt, Artificial Sequence
  VP1__Norovirus_and/or_Norovirus-like__AB541321
augaagauggcgucgaaugacgccaacccaucugauggguccacagccaaccucgucccagaggucaacaaugagguaauggcuuuggagcccguuguaggugccgcuauugcggcgccuguagcgggccaacaaaauguaauugaccccuggauuagaaauaauuuuguacaagccccugguggagaguuuacaguguccccccagaaugcucccagugagauacuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcagucccaccuaacuuuccaacugaaggcuugagcccuagccagguuacuauguucccccauauaauaguagauguuaggcaauuggaaccuguguugauccccuuaccugauguuaggaauaacuucuaucacuacaaccagucaaaugacccuaccauuaaauugauagcaauguuguacacaccacuuagggccaauaaugcuggggaugaugucuucacagucucuugucgaguccucacgagaccauccccugacuuugacuucauauuucugguaccaccaacaguugaaucaagaaccaaaccauuuaccguuccaaucuuaacuguugaggaaaugaccaauucaagauuccccauuccuuuggaaagguuguacacgggucccagcagugcuuuuguuguccagccacaaaacggcaggugcacgacugauggcgugcucuuagguaccacccagcugucugcugucaacaucugcaccuuuagaggggaugucacucacauugcaggcucucgcaauuauacaaugaauuuggccucucaaaauuggaacaacuaugauccaacagaagaaaucccagccccccugggcaccccagauuucgugggaaagauccaaggcaugcucacccaaaccacaagaagugauggcucgacccgcggccacaaggccacagugcucacugggagugccgacuucgccccaaaauugggcagaguucaauucgccacugacacagacaacgauuucgaaucuggccaaaacacgaaauucaccccaguuggcgucauccaggauggcuccacuacccaccgaaaugaaccucaacaauggguacucccaaauuacucagguagaacuggucauaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacuugcccccaugggaaaugggacggggcguagacguuaa

SEQ ID NO: 7206 - RNA, 1617 nt, Artificial Sequence
  VP1__Norovirus_and/or_Norovirus-like__AB541253
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuagaaauaacuucuaucauuauaaucagucgaaugauucuaccauuaaauugauagcaaugcuguauacaccacuuagggcuaauaaugcuggggaugaugucuucacagucucuugucgaguccucacgaggccauccccugauuuugauuucauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggacgucacccacauugcagguucucguaauuacacaaugaauuuggcuucucuaaauuggaacaauuaugacccaacagaagaaauuccagccccucuaggaacuccagauuucguaggaaagauccaaggugugcucacucaaaccacaaagggagauggcucgacccguggccacaaagcuacaguuuacacugggagugccccuuuuacuccaaagcugggcaguguucaauucaguacugauacagaaaaugauuuugaaacccaucaaaacacaaaauucaccccagucggugucauccaggaugguagcaccacccaccgaaaugaaccccaacaauggguacucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauuccccccaauggcuauuuuagguuugauuccuggguuaaucaauucuacacacuugcccccaugggaaauggaacggggcguaggcguuaa

SEQ ID NO: 7207 - RNA, 1617 nt, Artificial Sequence
  VP1__Norovirus_and/or_Norovirus-like__AB541250
augaagauggcgucgaaugacgccagcccaucugauggguccgcagccaaccucgucccagaggucaauaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacugucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaacuacacaaugaauuuggccucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaagacacaaaauucaccccagucggcgucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacguuaa

SEQ ID NO: 7208 - RNA, 1617 nt, Artificial Sequence
  VP1__Norovirus_and/or_Norovirus-like__AB541211
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacauuugcaccuucagaggggaugucacccacauugcagguucucguaauuacauaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7209 - RNA, 1617 nt, Artificial Sequence
  VP1__Norovirus_and/or_Norovirus-like__GQ246797
augaagauggcgucgagugacgccaacccaucugauggguccacagccaaccucgucccagaggucaacaaugagguuauggcuuuggagcccguuguuggugccgccauugcggcaccuguggcgggccaacaaaauguaauugaccccuggauuagaaacaauuuuguacaagccccugguggagaguucacaguauccccuaggaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcaguuccaccaaacuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagagcuaauaaugcuggagacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacucaacugucuccugucaacaucugcaccuucagaggggaugucacccauauugcagguagucgaaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguauacacugggagcgccgauuuugcuccaaaacuggguagaguucaauuugccacugacacagacaaugauuuugaugccaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggauguagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7210 - RNA, 1617 nt, Artificial Sequence
  VP1__Norovirus_and/or_Norovirus-like__GQ246794
augaagauggcgucgagugacgccaacccaucugauggguccacagccaaccucgucccagaggucaacaaugagguuauggcuuuggagcccguuguuggugccgccauugcggcaccuguggcgggccaacaaaauguaauugaccccuggauuagaaacaauuuuguacaagccccugguggagaguucacaguauccccuaggaacgcuccaggugaaauaccauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcaguuccaccaaacuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggagacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacucaacugucuccugucaacaucugcaccuucagaggggaugucacccauauuacagguagucgaaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguauacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggauguagcggguaccccaauauggauuuggacugucugcucccccaggaaugggugcaguauuucuaucaagaggcagccccagcacaaucugacguggcucugcuaagauuugugaauccagacacagguaggguuuuguuugaguguaagcuucauaaaucaggcuauguuacaguggcucauaccggccaacaugauuugguuaucccccccaaugguuauuuuagauuugauuccugggucaaccaguucuacacacuugcccccaugggaaauggaacggggcguagacguuaa

SEQ ID NO: 7211 - RNA, 1617 nt, Artificial Sequence
  VP1__Norovirus_and/or_Norovirus-like__EU876884
augaagauggcgucgaaugacgccaacccaucugauggguccacagccaaccucgucccagaggucaacagugagguuauggcuuuggagcccguuguaggugccgcuauugcggcgccuguagcgggccaacaaaauguaaucgaccccuggauuagaaauaacuuuguacaagccccugguggagaguucacaguguccccuagaaaugcuccaggugagauacuauggagugcgcccuugggcccugauuugaacccuuaccuuucucaucuggccagaauguacaaugguuaugcaggugguuuugaagugcaaguaauccuugcggggaacgcguucaccgccggaaaaaucauauuugcagcagucccaccuaacuuuccaacugaaggcuugagccccagccagguuaccauguucccccauauaauaguagauguuaggcaauuggaaccuguguugauccccuuaccugauguuaggaauaauuucuaucacuacaaccaaucaaaugacccuaccauuaaauugauagcaaugcuguauacaccacuuagggccaauaaugcuggggaugaugucuucacagucucuugucgaguccucacgagaccauccccugauuuugauuuuauauuuuugguacccccaacaguugaaucaagaaccaaaccauucaccgucccaaucuuaacuguugaggaaaugaccaauucaagauuccccauuccuuuggaaagguuguacacgggucccagcagugcuuuuguuguccagccacaaaacggcaggugcacgacugauggcgugcucuuaggcaccacccagcugucugcugucaacaucugcaccuuuagaggagaugucacccauauugcaggcucucgcaauuauacaaugaauuuggccucucaaaauuggaauaacuaugauccaacggaagaaaucccagccccccugggcaccccagauuucgugggaaagauccaaggcaugcucacccaaacuacaagaagugauggcucgacccgcggccacaaagccacagugcucacugggagugccgacuuugccccaaaguugggcagaguccaauucgccacugacacggacaacgauuucgaaucuggccaaaacacgaaauucaccccagucggcgucauccaggaugguuccaccacccaucgaaaugaaccccaacaauggguacucccaaguuacucagguagaacuggucauaaugugcaucuagccccugcuguugcccccacuuacccgggugagcaacuccucuucuucagguccacuaugcccggauguagcggguaccccaauauggaucuagauuguuugcuuccccaggaaugggugcagcacuucuaccaagaagcagcuccagcacaaucugauguagcucugcuaagauuugugaauccagacacaggcaggguucuauuugagugcaagcuccauaaaucaggauauguuacaguggcucauacuggucagcaugauuugguuauucccccuaaugguuauuuuagauuugauuccugggucaaccaguuuuacacacuugcccccaugggaaauggagcggggcguagacguuaa

SEQ ID NO: 7212 - RNA, 1617 nt, Artificial Sequence
  VP1__Norovirus_and/or_Norovirus-like__FJ411170
augaagauggcgucgaaugacgccagcccaucugauggguccacagccaaccucgucccagaggucaacaaugagguuauggcuuuggagcccguuguuggugccgcaauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuuucucauuuggccagaauguacaaugguuaugcaggugguuuugaagugcagguaauucucgcggggaacgcguucaccgccgggaagaucauauuugcagcagucccaccaaauuucccaacugaaggcuugagccccagccaggucacuauguucccccauauaauaguagauguuaggcaacuggaaccuguguugauccccuuaccugauguuaggaauaauuucuaucacuauaaucagucaaaugacccuaccauuaaacugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacgggucccagcggugccuuuguuguucaaccacaaaauggcaggugcacgacugauggcgugcucuuaggcacuacccaacugucuccugucaacaucugcaccuucagaggggaugucacccacauugcagguacucaugauuacacaaugaauuuggcuucucaaaauuggaacaauuacgacccaacagaagaaaucccagccccucugggaacuccagauuucgugggaaagauccaaggcgugcucacucaaaccacaaggggggauggcucgacccguggccacaaagcuacagugagcacugggaguguccacuuuacuccaaagcugggcaguguucaauucaccacugauacaaacaaugauuuugaaacuggccaaaacacgaaauucaccccagucggugucguccaggaugguaauaguacccaccaaaaugaaccccaacaaugggugcucccaaauuacucagguagaacuggccauaauguacaccuagccccugccguagcccccacuuuuccgggugagcaacuucuuuucuucagguccacuaugcccggaugcagcggguaucccaacaugaauuuggauugccuacucccccaggaaugggugcagcacuucuaccaagaggcagcuccagcacaaucugauguggcucugcugagauuugugaauccagacacagguaggguccuguuugagugcaaacuucauaaaucaggcuaugucacaguggcucacacuggccagcaugauuugguuaucccccccaauggcuauuuuagauuugauuccuggguuaaccaauucuacacacuugcccccaugggaaauggagcggggcguagacguuaa

SEQ ID NO: 7213 - RNA, 1617 nt, Artificial Sequence
  VP1__Norovirus_and/or_Norovirus-like__EU839589
augaagauggcgucgaaugacgcuaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagccagguuacuauguucccccacauaauaguagauguuaggcaauuggaaccuguguugauccccuuaccugauguuaggaacaacuucuaucauuauaaucagucaaaugauucuaccauuaaauugauagcaaugcuguauacaccacuuagggcuaauaaugcuggggaugaugucuucacagucucuugucgaguccucacgaggccauccccugauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucgugacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauuccguacugauacagaaaaugauuuugaaacucaccaaaacacaaaauucaccccagucggugucauccaggaugguagcaccacccaccgaaaugaaccccaacaaugggugcucccaaguuauucagguagaaauguccacaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccaacaugauuuggucaucccccccaauggcuauuuuagguuugauuccuggguuaaucaauucuacacacuugcccccaugggaaauggaacggggcguagacguuaa

SEQ ID NO: 7214 - RNA, 1617 nt, Artificial Sequence
  VP1__Norovirus_and/or_Norovirus-like__KX353961
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccacuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuagaaccuguguugauccccuuacccgauguuaggaauaauuuuuaucauuauaaucaaucaaaugaccccaccaucaaauugauagcaauguuguacacaccacuuagggcuaauaaugcuggggacgaugucuuuacaguuucuugucgaguucucacgagaccaucccccgauuuugauuucauauuuuuagugccacccacaguugaaucaagaacuaaaccauucucugucccaauuuuaacuguugaagaaaugaccaauucaagguuccccauuccuuuggaaaaguuguucacgggccccaguaguaccuuuguuguucaaccacaaaacggcaggugcacgacugauggcgugcuccuagguacuacccaacugucuccugucaacaucugcaccuucagaggggaugucacccacauugcaggcagucguaacuacacaaugaaccuggcuucccaaaauuggaacaguuaugacccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguagaguucaauuugccacugacacagacaaugauuucgaugcuaaccaaaacacaaaguucaccccagucgguguuauccaggauggugauacugcccaccgaaaugaaccccaacaaugggugcucccaaguuacucaggcagaaacacucauaaugugcaccuggcccccgcuguagcccccacuuuuccgggugagcaacuccucuucuucagaucuaccaugcccggaugcagcggguaccccaacauggauuuggacugucugcucccccaggaaugggugcaguauuucuaccaggaagcagccccagcacaaucugauguggcucugcuaagauuugugaauccagacacagguaggguucuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7215 - RNA, 1617 nt, Artificial Sequence
  VP1__Norovirus_and/or_Norovirus-like__AB933757
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaacuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuuucagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccauaaaauugauagcgauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccacuccuuuggaaaagcuguucacgggccccaguaguaccuuuguuguucaaccacaaaacggcaggugcacgacugauggcgugcuccuagguaccacccaacugucuccugucaacaucugcacuuucagaggggaugucacccauauuacaggcagucauaacuauacaaugaaucuggcuucccaaaauuggaacaguuaugacccaacagaagagaucccagccccucuagggacuccagauuucguggggaagauucaaggcgugcucacccaaaccacaaggacggauggcucgacccgcggccacaaagcuacaguguacacugggagcgccgaauuuuccccaaaacuggguagaguucaaguugccacugacacaaacaaugauuuugaugccaaccaaaacacaaaguucaccccagucgguguuauccaggauggugguacuacccaccgaaaugaaccccaacaaugggugcuuccaaguuacucaggcagaaaugcucacaaugugcaccuggcccccgcuguagcccccacuuuuccgggugagcagcuccucuuuuucaggucuaccaugcccggaugcagcggguaccccaacauggauuuggacugucuacucccccaggaaugggugcagcauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7216 - RNA, 1617 nt, Artificial Sequence
  VP1__Norovirus_and/or_Norovirus-like__KM245074
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucauuauaaucagucaaaugauuccaccauuaaguugauagcaaugcuguauacaccacuuagggccaauaaugccggggaugaugucuucacagucucuugucgaguccucacgaggccauccccugauuuugacuucauauuuuuggugccaccuacaguugagucaagaacuaagccauucacugucccaaucuugacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaauuccagccccucugggaacuccagauuucgugggaaagauccaaggugugcucacucaaaccacaaagggggauggcucgacccggggccauaaagcuacagucuacacugggagugccgacuuuacuccaaagcugggcaguguucaauuugcuacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggucaacaugauuuggucaucccccccaaugguuauuuuagguuugauuccuggguuaaucaauucuauacacuugcccccaugggaaauggaacggggcguagacgauaa

SEQ ID NO: 7217 - RNA, 1617 nt, Artificial Sequence
  VP1__Norovirus_and/or_Norovirus-like__EU921368
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguaucccccagaaacgcuccaggugaaauauuguggagcgcgcccuugggcccugauuugaaucccuaccuuucccauuuguccagaauguauaaugguuaugcaggugguuuugaggugcaggugauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuaccugauguuaggaacaauuucuaccauuacaaucaaucaaaugaccccaccaucaaauugauagcaaugcuguauacaccacuuagggcuaauaaugcuggggacgacgucuucacagucucuugucgaguucucacgagaccauccccugauuuugauuuuauauuuuuggugccacccacaguugagucaagaacuaaaccauucucugucccaaucuuaacuguugaggagaugaccaauucaagauucccuaucccuuuggaaaaguuguucacgggucccagcagugccuuuguuguucaaccacaaaauggcaggugcacgacugauggcgugcucuuagguaccacccaacuguccccugucaacaucugcaccuucagggggaaugucaccaacauugcagguucucaaacuuacacaaugaaucuggccucccaaaauuggaacaauuaugacccaacagaagaaaucccagccccucuggguacuccagauuuuguaggaaagauccaaggcgugcucacccaaaccacaaagggggauggcucgacccgcggucacaaagccacagugagcacuggaagugcccaauuuaccccaaagcugggcaguguucaauucuccacugauacaagcacugacuuugaaacuggccaaaacacgagauucaccccagucggugucauccaggaugguagcaccacccacaaaaaugaaccccaacaaugggugcucccaagcuacucagguagagauagucacaauguacaccuagccccugcuguggccccuacuuuuccgggugagcaaauucuuuucuuuagguccacuaugcccggaugcagcggguaccccaacauggauuuggauugccuacucccccaggagugggugcagcacuucuaccaagagucagccccagcacaaucugauguggcacugcugagauuugugaauccagacacagguaggguuuuguuugagugcaagcuccauaagucaggcuauguaacaguggcucacacuggccaacaugauuuaguuaucccccccaauggcuauuuuagauuugauuccugggucaaccaauucuacacucuugcccccaugggaaauggagcggggcguagacguuaa

SEQ ID NO: 7218 - RNA, 1617 nt, Artificial Sequence
  VP1__Norovirus_and/or_Norovirus-like__EU921338
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaucuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaacuggaaccuguguugauccccuuaccugauguuaggaacaauuucuaucauuacaaucaaucaaaugaucccaccaucaaauugauagcaaugcuguauacgccacuuagggcuaacaaugcuggggacgaugucuucacagucucuugucgaguucuuacgagaccaucccccgauuuugauuucauauuuuuggugccgcccacaguugagucaagaacuaaaccauucucugucccaaucuuaacuguugaggagaugaccaauucaagauucccuauuccuuuggaaaaauuguuuacgggucccagcagugccuuuguuguucaaccacaaaauggcagaugcacgacugauggcgugcucuuagguacuacccaacugucuccugucaacaucugcaccuucagaggggaugucacccacauugcaggcacucaaaacuacacaaugaaucuggccucccaaaauuggaacaauuaugacccaacagaagaaaucccagccccucugggaaccccagauuuuguaggaaagauccaaggcgugcucacccaaaccacaaggggggauggcucgacccgcggucacaaagccacagugagcacuggaaguguccacuuuaccccaaaguugggcaguguucaauucuccacugauacaagcaaugacuuugaaacuggccaaaacacgagguucaccccagucggugucguccaggaugguaguaccacccaccaaaaugaaccccaacaaugggugcucccagcuuauucagguagagacaaccacaauguacaccuagccccugccguggcccccacuuuuccgggugagcaacuucuuuucuuuagguccacuaugcccggaugcagcggguaucccaacaugaauuuggauugccuacucccccaggagugggugcaacacuucuaccaagagucagccccagcacaaucugauguggcauugcugagauuugugaauccagacacagguagggucuuguuugagugcaagcuucauaaaucaggcuauguaacaguggcucacacuggccaacaugauuugguuaucccccccaauggcuauuucagauuugauuccugggucaaccaauucuacacacuugcccccaugggaaauggagcggggcguagacguuaa

SEQ ID NO: 7219 - RNA, 1617 nt, Artificial Sequence
  VP1__Norovirus_and/or_Norovirus-like__LC005708
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacugucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggccucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauuccccccaaugguuauuuuagguuugauuccuggguuaaucaauuuuacacgcuugcccccaugggaaauggaacggggcguagacguuaa

SEQ ID NO: 7220 - RNA, 1617 nt, Artificial Sequence
  VP1__Norovirus_and/or_Norovirus-like__LC005704
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccaguggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuacucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7221 - RNA, 1617 nt, Artificial Sequence
  VP1__Norovirus_and/or_Norovirus-like__KF429777
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaaucauauuugcagcaguuccaccaaauuuuccaacugaaggcuugagucccagccaaguuacuauguucccccacauaauaguagauguuaggcaauuggaaccuguguugauccccuuaccugauguuaggaauaacuucuaucacuauaaccagucaaaugauucuaccauuaaauugauagcaaugcuguacacaccacucagagccaauaaugccggggaugaugucuucacggucucuugucgaguccucacgaggccauccccugauuuugacuucauauuucuggugccaccuacaguugagucaagaacuaagccauuuacugucccaaucuugacuguugaagaaaugaccaauucaagauuccccauuccuuuggagaaauuguucacgggucccagcagugccuuuguuguucaaccacaaaauggcagaugcacaacugauggcgugcucuuaggcaccacccaacugucuccugucaacaucugcaccuucagaggggaugucacccacauugcggguucccguaauuacacaaugaauuuggccucucuaaauuggagcaauuacgacccaacagaagagauuccagccccucugggaacuccagauuucgugggaaagauccaaggugugcucacucaaaccacaaagggagauggcucgacccggggccauaaagcuacaguuuacacugggagugccgacuucacuccaaagcugggcaguguucaauuugcuacugauacagaaaaugacuuugaaacucaccaaaacacaagauucaccccagucggugucauucaggaugguggcaccacccaccgaaaugaaccccaacaaugggugcucccaaguuacucagguagaaauguccauaauguacaccuagccccugcuguagcccccaauuuuccaggugaacagcuccuuuucuucagguccacuaugcccggauguagcggauaucccaacauggauuuggauugccuacucccccaggagugggugcaacacuuuuaccaagaggcagcuccagcacaaucugauguggcucuauugagauuugugaauccagacacggguagggucuuguuugagugcaaacuccauaaaucaggcuaugucacaguggcucauaccggccaacaugauuuggucauuccccccaaugguuauuuuagguuugauuccuggguuaaucaguucuacacacuugcccccaugggaaauggaacggggcguagacguuaa

SEQ ID NO: 7222 - RNA, 1617 nt, Artificial Sequence
  VP1__Norovirus_and/or_Norovirus-like__JX439840
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguuuacaguguccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauuccaccauuaaauugauagcaaugcuguauacaccacuuagggcuaauaaugcuggggaagaugucuucacagucucuugucgaguucucacgagaccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaauuccagauuuugugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagaaauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacagguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7223 - RNA, 1617 nt, Artificial Sequence
  VP1__Norovirus_and/or_Norovirus-like__JX644026
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuacuauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguagcaccacccaccgaaaugaaccccaacaaugggugcucccaaguuauucagguagaaaugcccagaauguacaccuagccccugcuguagcccccacuuuuccgggugaacaacuucuuuucuuuagguccacuaugcccggaugcagcggguaucccaacauggaucuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7224 - RNA, 1617 nt, Artificial Sequence
  VP1__Norovirus_and/or_Norovirus-like__JX459906
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcucccuuaggcccugaucugaaucccuaccuaucucauuuggccagaauguauaaugguuaugcaggugguuuugaagugcagguaauccucgcggggaacgcguucaccgccggaaaaauuauauuugcagcagucccaccaaauuucccgacugaaggcuugagucccagccaggucacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauucaaggugugcucacucaaaccacaaagggagaugguucgacccguggucauaaagcuacaguuuacacugggagugcccccuucacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacgggcaggguucuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7225 - RNA, 1617 nt, Artificial Sequence
  VP1__Norovirus_and/or_Norovirus-like__JX459597
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuaugccacgcgcccuugggcccugauuugaaucccuaccuuucccauuuggccagaauguacaaugguuaugcaggugguuuugaagugcagguaauccucgcggggaacgcguucaccgccgggaaaaucauauuugcagcaguuccaccaaauuucccaacugaaggcuugagccccagucaggucacuauguucccccauauaauaguagauguuaggcaacuggaaccuguguugaucccccugccugauguuaggaauaacuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcuuuuagguacuacccaacugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaggauccaaggcgugcucacccaaaccacaaggagggacggcucgacccgcggucacaaagccacauuaagcacuggaaguguccacuucaccccaaagcugggcaguguucaauucucuacugauacaagcaaugacuuugaaacuggccaaaacacgagauucaccccagucggugucguccaggaugguaguaccacccaccaaaaugaaccccaacaaugggugcucccaaacuauucagguagagauagucacaauguacaccuagccccugccguggcccccacuuuuccaggugagcaacuucuuuucuuuagguccacuaugcccggaugcaguggguaucccaacaugaauuuggauugccuacucccccaggagugggugcagcacuucuaccaagagucagccccagcacaaucugauguggcacugcugagauuugugaauccagacacagguaggguuuuguuugagugcaagcuccauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7226 - RNA, 1617 nt, Artificial Sequence
  VP1__Norovirus_and/or_Norovirus-like__HQ456334
augaagauggcgucgaaugacgccagcccaucugauggguccgcagccaaccucgucccagaggucaacaaugagguuauggcuuuggagcccguugucggugccgcaauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauucacugucccaaucuuaacuguugaagaaaugacuaauucaagauuccccauuccuuuggaaaaguuguucacgggucccagcggcgccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggccauaaagcuacaguuuauacugggagugccgacuuuacuccaaagcugggcaguguucaauucaauacugauacagaaaaugauuuugaaacucaccaaaacacaaaauucaccccagucggugucauccaggaugguagcaccacccaccgaaaugaaccccaacaaugggugcucccgaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7227 - RNA, 1617 nt, Artificial Sequence
  VP1__Norovirus_and/or_Norovirus-like__HM802553
augaagauggcgucgaaugacgccagcccaucugauggguccgcagccaaccucgucccagaggucaacaaugagguuauggcuuuggagcccguuguuggugccgcuauugcggcaccuguggcgggccaacaaaauguaauugaccccuggauuaggaauaauuuuguacaagccccugguggagaguucacaguguccccuagaaacgcuccaggugaaauacuauggagcgcgcccuuagguccugaucugaacccauaccuuucucaccuggccagaauguacaaugguuaugcaggugguuuugaagugcagguacuccucgcggggaacgcguucaccgccgggaaaaucauauuugcagcagucccaccaacuuuuccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugguagcaaugcuguacacaccacuuagggcuaauaaugcuggggaugaugucuucacagucucuugucgaguccucacgaggccaucccccgauuuugauuuuauauuucuggugccacccacaguugagucaagaaccaaaccauucaccgucccaauuuuaacuguugaggaaaugaccaauucaagauuccccauuccuuuggaaagauuguucacgggucccagcagugccuuuguuguccaaccacaaaauggcaggugcacgacugacggcgugcucuuaggcacuacccaacugucccccgucaacaucugcaccuucagaggcgaugucaccaacauuccagguucucguacuuacagaaugaauuuggcuucucaaaauuggaacaauuaugacccaacggaagaaaucccagccccucugggaacuccagauuucgugggaaagauccaaggcgugcucacccaaaccacaaagggagacggcucgacccgcggucacaaagcuacagugagaacugggagugcugauuuuacuccaaagcugggcagcguucaguucgccacugauacagacaaugauuuuguaaccggccaaaacacaagguucaccccagucggugucauccaugaugguaguagugcccacagaaaugaaccccaacaauggguacucccagaauacucagguagaucuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccgucacaaucugauguggcuuugcugagauuugugaauccggacacagguaggguucuguuugagugcaagcuucauaaagcaggcuaugucacaguggcucacacuggccagcaugauuugguuaucccucccaauggcuacuuuagauuugauuccugggucaaccaguucuacacacuugcccccaugggaaauggagcggggcguagacguuaa

SEQ ID NO: 7228 - RNA, 1617 nt, Artificial Sequence
  VP1__Norovirus_and/or_Norovirus-like__HQ008055
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauucucgcggggaaugcguucaccgccggaaaaaucauauuugcagcagucccaccaaauuucccaacugaaggcuugagccccagccaggucacuauguucccccauauaauaguggauguuaggcaauuggaaccuguguugauccccuuacccgauguuaggaauaauuucuaucacuacaaucaauuaaaugaccccaccaucaaauugauagcaauguuguauacaccacuuagggcuaauaaugcuggggacgaugucuucacaguuucuugucgaguucuuacgagaccaucccccgauuuugauuucauauuuuuggugccaccuacaguugagucaagaacuaaaccauucucugucccaauuuuaacuguugaggagaugaccaauucaagauuccccauuccuuuggaaaaguuguucacgggucccagcagugccuuuguuguucaaccacaaaacgguaggugcacgacugauggcgugcuccuagguacuacucaacuaucuccugucaacaucugcaccuucagaggggaugucacccauaucacagguagucauaacuacacaaugaauuuggcuucucaaaauuggaacaguuaugacccaacagaagaaaucccagccccucuaggaacuccagauuucguggggaagauccaaggugugcucacccaaaccacaagagcagauggcucgacccgcggccacagagcuacaguguacacugggagcgccgaauuugcuccaaagcuggguagaguucaauuugccacugacacagaaaaugauuuugauacuaaccaaaacacaaaguucaccccagucggugucauccaggaugguaauacuacccaccgaaaugaaccccaacaaugggugcucccaaguuacucaggcagaaauagucacaaugugcaucuggcccccgcuguagcccccacuuuuccgggugagcaacuucucuucuucagauccacuaugcccggaugcagcggguaccccaacuuggauuuggacugucuacucccccaggaaugggugcagcacuucuaccaagaggcagccccagcacaaucugauguggcucugcugagauuugugaauccagacacagguaggguuuuguuugaguguaagcuucauaaaucaggcuauguuacaguggcucacacuggccaacaugauuugguuaucccccccaaugguuauuucagauuugauuccugggucaaccaguucuacacacuugccccuaugggaaauggaacggggcguagacguuaa

SEQ ID NO: 7229 - RNA, 1617 nt, Artificial Sequence
  VP1__Norovirus_and/or_Norovirus-like__AB541360
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugacguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaacuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaauucaccaaaacacaaaauucaccccagucggugucauccaggaugguagcaccacccaccgaaaugaaccccaacaaugggugcucccaaguuauucagguagaaauguccauaauguacaccuagccccugcuguggcucccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcuuacaccggccagcaugauuuggucaucccccccaaugguuauuuuagguuugauuccuggguuaaucaauucuacacacuugcccccaugggaaauggaacggggcguagacguuaa

SEQ ID NO: 7230 - RNA, 1617 nt, Artificial Sequence
  VP1__Norovirus_and/or_Norovirus-like__AB541262
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccacauaauaguggauguuaggcaauuggagccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacauuuguaccuucagaggggaugucacccacguugcagguucucguaauuacauaaugaauuuggcuucucuaaauuggaauaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggauguagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7231 - RNA, 1617 nt, Artificial Sequence
  VP1__Norovirus_and/or_Norovirus-like__AB541231
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagucaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccgcuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuugcuguucaaccacaaaauggcagaugcacgacugauggcgugcucuuaggcaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcuggguaguguucaauucaguacugauacagagaaugauuuugaaacucaccaaaacacaaaauucaccccagucggugucauccaggaugguagcaccacccaucgaaaugaaccccaacaaugggugcucccaaguuauucagguagaaaugucccuaacguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucauaccggccagcaugauuuggucaucccccccaaugguuauuucagguuugauuccuggguuaaucaauucuacacacuugcccccaugggaaauggaacggggcguagacguuaa

SEQ ID NO: 7232 - RNA, 1617 nt, Artificial Sequence
  VP1__Norovirus_and/or_Norovirus-like__GQ246792
augaagauggcgucgagugacgccaacccaucugauggguccacagccaaccucgucccagaggucaacaaugagguuauggcuuuggaacccguuguuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuaggcccugauuugaaucccuaccuuucccauuuggcuagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguggauguuaggcaacuggaaccuguguugauccccuuacccgauguuaggaauaauuucuaucacuacaaucaaucaaaugaccccaccaucaaacugauagcaauguuauauacaccacuuagggcuaauaaugcuggggacgacgucuucacaguuucuugucggguucucacaagaccaucccccgauuuugauuucauauuuuuagugccacccacaguugagucaagaacuaaaccauucucugucccaaucuuaacuguugaggagaugaccaauucaagauuccccauuccuuuggaaaaguuguucacgggucccaguagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggccacucaaaauuggaacaguuaugacccuacagaagaaaucccagccccccuaggaacuccagauuucguggggaagauucaaggcgugcucacccaaacuacaagggcagauggcucgacccgcggccacaaagcuacaguguacacugggagcgccgauuuuacuccaaaacuggguagaguucaauuugccacugacacagacaaugauuuugaugcuaaccaaaacacaaaguucaccccagucggugucauccaggaugguaauacugcccaccgaaaugaaccccaacaaugggugcucccaaguuacucaggcagaaauagucacaaugugcaccuggcccccgcuguagcccccacuuuuccgggugagcaacuucucuucuucagguccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaaacuucauaaaucaggcuauguuacaguggcucacaccggccaacaugauuugguuaucccccccaaugguuauuucagauuugauuccugggucaaccaguucuacacacuugcccccaugggaaauggaacggggcguagacguuaa

SEQ ID NO: 7233 - RNA, 1617 nt, Artificial Sequence
  VP1__Norovirus_and/or_Norovirus-like__AB504329
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgagaccguccccugauuuugauuuuauauuuuuggugccacccacaguugagucaagaacuaaaccauuuacugucccaaucuuaacuguugaagaaaugaccaauucaagauuccccauuccuuuagaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaacuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccugggucaaucaauucuacacacuugcccccaugggaaauggaacggggcguagacguuaa

SEQ ID NO: 7234 - RNA, 1617 nt, Artificial Sequence
  VP1__Norovirus_and/or_Norovirus-like__AB504306
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaauuuacaguguccccuagaaacgcuccgggugagauacuauggagcgcgcccuugggcccugauuuaaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaacuuuuaucauuacaaucaaucaaaugauucuaccauuaaauugauagcaaugcuguauacaccacuuagggcuaauaaugcuggagaugaugucuucacagucucuugucgaguccucacgaggccaucccccgauuuugauuucauauucuuggugccacccacaguugaaucaagaacuaaaccauuuaccgucccaaucuuaacuguugaggaaauguccaaaucaagauuccccauuccuuuggaaaaguuguacacgggucccagcagugcuuuuguuguccaaccacaaaauggcaggugcacgacugauggcgugcucuuaggcacuacccaacuaucuguugucaacaucugcaccuucagaggggaugucacccacauugcaggcagucacgacuauacaaugaauuuggcuucucaaaauuggaacaauuaugacccaacagaagaaaucccagccccucugggaaccccagauuucgugggaaagauccaaggcaugcucacccaaaccacaagagaggauggcucgacccgcgcccacaaagccacagugagcacugggaguguccacuuuacuccaaagcuggguaguguucaauacaccacugacacaaacaaugacuuucaaacuggccaaaacacgaaauucaccccagucggcgucauccaggacgguaauaaccaucaaaaugaaccccaacaauggguacucccaaacuacucagguagaacuggucauaaugugcaccuagcuccugccguugcccccacuuuuccgggagagcaacuucucuucuuuagguccacuaugcccggguguagcggguaucccaacaugaauuuggauugccuacucccccaggagugggugcagcacuucuaccaagaagcagccccagcacaaucugauguggcucugcugagauuugugaauccagacacagguagguuucuguuugagugcaagcuccauaaaucaggcuaugucacaguggcucacacaggcccgcaugauuuggucaucccccccaaugguuacuuuagauuugauuccugggucaaccaguucuacacacuugcccccaugggaaauggagcggggcgcagacguguauaa

SEQ ID NO: 7235 - RNA, 1617 nt, Artificial Sequence
  VP1__Norovirus_and/or_Norovirus-like__GQ303445
augaagauggcgucgagugacgccaacccaucugauggguccacagccaaccucgucccagaggucaacaaugagguuauggcuuuggagcccguuguuggcgccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaauuauauuugcagcagucccaccaaauuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaacugauagcaauguuguauacaccacuuagggcuaauaaugcuggggacgaugucuucacaguuucuugucggguucucacgagaccaucccccgauuuugauuuuauauuuuuagugccacccacaguugagucaagaacuaaaccauucucugucccaauuuuaacuguugaggagaugaccaauucaagauuccccauucccuuggaaaagcuguucacgggucccagcagugccuuuguuguucaaccacaaaacggcaggugcacgacugauggcgugcuccuaggcaccacccaacugucuccugucaacaucugcacuuucagaggggaugucacccauauuacagguagucguaacuacacaaugaauuuggcuacucaaaacuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagaccaugauuuugaugcuaaccaaaacacaaaguucaccccagucggugucauccaggauggugauacugcccaccgaaaugagccccaacaaugggugcucccaaguuacucaggcagaaauagucacaaugugcaccuggcccccgcuguagcccccacuuuuccaggugagcaacuccucuucuucagauccacuaugcccggaugcagcggguacccuaacauggacuuggacugucugcucccucaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7236 - RNA, 1617 nt, Artificial Sequence
  VP1__Norovirus_and/or_Norovirus-like__EU839588
augaagauggcgucgaaugacgccaacccaucugauggguccgcagccaaccucgucccagaggucaacaaugaggucauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaguugauagcaaugcuguauacaccacuuagggcuaauaaugcuggggaagaugucuuuacagucucuugucgaguucucacgaggccauccccugauuuugauuuuauauuuuuggugccaccuacagucgagucaagaacuaaaccauuuacuguuccaaucuuagcuguugaagaaaugaccaauucaagauuccccauuccuuuggaaaaauuguucacgggucccagcagugccuuaguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucgguacugauacagaaaaugauuuugaaacucaccaaaacacaaaauucaccccagucggcgucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcaacacuucuaccaagaggcagcuccagcacaaucugauguggcucuauugagauuugugaauccagacacggguaggguccuguuugagugcaaacuucauaaaucaggcuaugucacaguggcucacaccggccagcaugaucuggucaucccccccaaugguuauuuuagguuugauuccuggguuaaucaauucuacacacuugcccccaugggaaauggaacggggcguagacguuaa

SEQ ID NO: 7237 - RNA, 1617 nt, Artificial Sequence
  VP1__Norovirus_and/or_Norovirus-like__DQ364459
augaagauggcgucgaaugacgccagcucaucugaugggucuacagcaaaccucgucccagaggucaacaaugagguuauggcuuuggagcccguuguuggugccgcaauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuuucucauuuggcccgaauguacaaugguuaugcaggugguuuugaagugcagguaauccucgcggggaacgcguucaccgccgguaaaaucauauuugcagcagucccaccaaauuuuccaacugaaggcuugagccccagccaggucaccauguucccccauauaauaguagauguuagacaacuggaaccuguguugauccccuuaccugauguuaggaauaauuucuaccacuauaaucagucaaaugacccuaccauuaaacugauagcaaugcuauacacaccacuuagggcuaauaaugcuggggaugaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacgggucccagcagugccuuuguuguccaaccacaaaauggcagaugcacgacugacggcgugcucuuaggcacuacccaacugucuccugucaacaucugcaccuucagaggggaugucacccacauugcagguacucaugauuacacaaugaauuuggcuucucaaaauuggaacaauuacgacccaacagaagaaaucccagccccucugggaacuccagauuucgugggaaagauccaaggcgugcucacucaaaccacaaggggagacggcucaacccguggccacaaagcuacagugagcacugggaguguccacuuuacuccaaagcugggcaguguucaauucaccacugauacaaacaaugauuuugaaacuggccaaaacacgaaauucaccccagucggugucguccaggauggcaauaguacccaccaaaaugaaccccaacaaugggugcucccaaauuacucaggcagaacuggccacaauguacaccuagccccugccguagcccccacuuuuccgggugagcaacuucuuuucuucagguccacuaugcccgguugcagcggguaucccaacaugaauuuggauugccuacucccccaggaaugggugcagcacuucuaccaagaggcagcuccagcacaaucugauguggcucugcugagauuugugaauccagacacagguaggguccuguuugagugcaaacuucauaaaucaggcuaugucacaguggcucacacuggccagcaugauuugguuaucccccccaauggcuauuuuagauuugauuccuggguuaaccaauucuacacacuugcccccaugggaaauggagcggggcguagacguuaa

SEQ ID NO: 7238 - RNA, 1617 nt, Artificial Sequence
  VP1__Norovirus_and/or_Norovirus-like__KY628449
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaauucacaguauccccuagaaacgcuccaggugaaauacuauggagcgcgcccuugagcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagcccuagccaggucacuauguucccccauauaguaguagauguuagacaacuagaaccuguguugauccccuuacccgauguuaggaauaauuucuaucauuacaaucaaucaaaugacuccaccaucaaauugauagcaauguuguauacaccacuuagggccaauaaugcuggggaugaugucuucacagucucuugucgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugacuuugcuguccaaccacaaaacgguaggugcacgacugauggcgugcuccuaggcaccacccaacugucuccugucaacaucugcaccuucagaggagaugucacccauaucaacgggaguaguaacuacaaaaugaauuuggcuaaucaaaauuggagcaauuaugacccaacagaagaaaucccagccccucuaggagcuccagacuuuguggggaagauucaaggcgugcucacccaaacuacaaaggaagauggcucaacacgcggccacaaagccacaguguacacugggagcgccgacuuugcuccaaaacuggguagaguucaauuugaaacugacacagaccaugaccuugaaaucgaccaaaacacaaaguucaccccaguuggugucauccaaaauggugguaccacccaccgaaaugaacccaaacaguggaugcucccaaguuacucagguagaaauacuccuaaugugcaucuggcccccgcuguagcccccacuuuuccuggugaacaacuucucuucuucagauccaccaugcccggaugcagcggguaccccaacauggauuuggacugucugcucccccaggaaugggugcagcacuucuaccaagaggcagccccagcacaaucugauguggcucugcuaagguuugugaacccagacacagguaggguuuuguuugaauguaaacuucauaaaucaggcuauguuacaguggcucacucuggccaacaugauuugguugucccccccaaugguuauuuuagguuugauuccugggucaaucaguuuuacacgcuugcccccaugggaaauggaucggggcguagacguuaa

SEQ ID NO: 7239 - RNA, 1617 nt, Artificial Sequence
  VP1__Norovirus_and/or_Norovirus-like__KX371608
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgcgggaaaaauuauauuugcagcagucccaccaaauuuuccaacugaaggcuugagucccagccagguuacuauguucccccacauaauaguagauguuaggcaauuggaaccuguguugauccccuuaccugauguuaggaacaacuucuaucacuauaaccagucaaaugauucuaccauuaaauugauagcaaugcuguacacaccacucagggccaauaaugccggggaugaugucuucacagucucuugucgaguccucacgaggccauccccugauuuugacuucauauuucuggugccaccuacaguugagucaagaacuaagccauuuacugucccaaucuugacuguugaagaaaugaccaauucaagguuccccauuccuuuggagaaauuguucacgggucccagcagugccuuugucguucaaccacaaaauggcagaugcacaacugacggcgugcucuugggcaccacccaacugucuccugucaacaucugcaccuucagaggggaugucacccacauugcggguucccauaauuacacaaugaauuuggccucucuaaauuggaacaauuaugacccaacagaagagauuccagccccucugggaacuccagauuucguggggaagauccaaggugugcucacucaaaucacaaagggagauggcucgacccggggccauaaagccacaguuuacacugggagugccgacuucacuccaaagcugggcaguguucaauuugcuacugacacagaaaaugacuuucaaacucaccaaaacacaagauucaccccagucggugucauucaggaugguggcaccacccaccaaaaugaaccccaacaaugggugcucccaaguuauucagguagaaauguccauaauguacaccuagccccagcuguagcccccaauuuuccaggugaacaacuccuuuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguagggucuuguuugagugcaaacuccauaaaucagguuaugucacaguggcucauaccggccaacaugauuuggucaucccccccaaugguuauuuuagguuugauuccuggguuaaucaguucuacacacuugcccccaugggaaauggaacggggcguaggcguuaa

SEQ ID NO: 7240 - RNA, 1617 nt, Artificial Sequence
  VP1__Norovirus_and/or_Norovirus-like__KX354089
augaagauggcgucgaaugacgccaacccaucugauggguccgcagccagccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuaggaacgcuccaggugaaauacuauggagcgcacccuuaggcccugauuugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucacuauaaucagucaaaugauucuacuauuaaauugauagcaaugcuguauacaccacuuagggccaauaaugcuggggaugaugucuucacagucucuugucgaguccucacgaggccauccccugauuuugacuuuauauuuuuggugccaccuacaguugagucaagaacuaagccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacaucugcaccuucagaggggacgucacccacauugcggguucucguaauuacacaaugaauuuggccucucuaaauuggaacaauuaugacccaacagaggaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaacccaccaaaacacaaaauucaccccagucggugucauccaggaugguggcaccacccaucgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccaacaugauuuggucaucccccccaauggcuauuuuagauuugauuccuggguuaaccaguucuacacacuugcccccaugggaaauggaacggggcguagacguuaa

SEQ ID NO: 7241 - RNA, 1617 nt, Artificial Sequence
  VP1__Norovirus_and/or_Norovirus-like__KX354001
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgcgggaaaaauuauauuugcagcagucccgccaaauuuuccaacugaaggcuugagucccagccagguuacuauguucccccacauaauaguagauguuaggcaauuggaaccuguguugauccccuuaccugauguuaggaauaacuucuaucacuauaaccagucaaaugauucuaccauuaaauugauagcaaugcuguacacaccacucagggccaauaaugccggggaugaugucuucacagucucuugucgaguccucacgaggccauccccugauuuugacuucauauuucuggugccaccuacaguugagucaagaacuaagccauucacugucccaaucuugacuguugaagaaaugaccaauucaagauuccccauuccuuuggagaaauuguucacgggucccagcagugccuuuauuguucaaccacaaaauggcagaugcacaacugauggcgugcucuuaggcaccacccaacugucuccugucaacaucugcaccuucagaggggaugucacccacauugcggguucccgcaauuacacaaugaauuuggccucucuaaauuggaacaauuaugacccaacagaagagauuccagccccucugggaacuccagauuucgugggaaagauccaaggugugcucacucaaaccacaaagggagaugguucgacccggggccauaaagcuacaguuuacacugggagugccgacuucacuccaaagcugggcaguguucaauuugcuacugacacagaaaaugacuuugaaacucaccaaaacacaagauuuaccccagucggugucauucaggaugguggcaccacccaccgaaaugaaccccaacaaugggugcucccaaguuauucagguagaaauguccauaauguacaccuagccccugcuguagcccccaauuuuccaggugaacaacuccuuuucuucagguccacuaugcccggaugcagcggguaucccaacauggauuuggauugccuacucccccaggagugggugcaacacuucuaccaagaagcagcuccagcacaaucugauguggcucuauugagauuugugaauccagacacggguagggucuuguuugagugcaaacuccauaaaucaggcuaugucacaguggcucauaccggccaacaugaucuggucaucccccccaaugguuauuuuagguuugauuccuggguuaaccaguucuacacacuugcccccaugggaaauggaacggggcguagacguuaa

SEQ ID NO: 7242 - RNA, 1617 nt, Artificial Sequence
  VP1__Norovirus_and/or_Norovirus-like__KX353971
augaagauggcgucgaaugacgccagcccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagacguuaggcaauuggaaccuguguugauccccuuacccgauguuaggaacaauuucuaccauuauaaucaaucaaaugaccccacuaucaaauugauagcaauguuguacacaccacuuagggcuaauaaugccggggacgaugucuucacaguuucuugucgaguucucacgagaccaucccccgauuuugacuucauauuuuuggugccacccacaguugaaucaagaacuaaaccauuuucugucccaguuuuaacuguugaggagaugaccaauucaagguuccccauuccuuuggaaaaguuguucacgggccccaguagugccuuuguaguucaaccacaaaauggcaggugcacgacugauggcgugcuccuagguacuacccaacuguccccugucaacaucugcaccuucagaggugaugucacccauauuacaggcagucguaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacugggcagaguucaauuugccacugacacagacaaugauuuugaaaccaaccaaaacacaaaguucaccccagucgguguuauacaggaugguggcaccacccaccgaaaugaaccccaacaaugggugcucccaaguuacucaggcagaaauacucauaaugugcaucuggcccccgcuguagcccccacuuucccaggcgagcagcuccucuucuucagaucuacuaugcccggaugcagcggguaucccaacauggauuuggacugucugcucccccaggaaugggugcaguauuucuaccaagaggcagccccagcacaaucugauguggcucuuuuaagguuugugaauccagacacagguaggguuuuguuugaguguaagcuccauaaaucaggcuaugucacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7243 - RNA, 1617 nt, Artificial Sequence
  VP1__Norovirus_and/or_Norovirus-like__KR131766
augaagauggcgucgaaugacgccaauccaucugauggauccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguuuacgguguccccuagaaaugcuccaggugagauacuauggagugcgcccuugggcccugauuugaacccuuaccuuucucaucuggcuagaauguauaaugguuaugcaggugguuuugaagugcagguaauccucgcggggaacgcguucaccgccggaaaaaucauauuugcagcaguuccaccuaacuuuccaacugaaggcuugagccccagccagguuacuauguucccucauauaauaguagauguuaggcaauuggaaccuguguugauccccuuaccugauguuaggaauaacuucuaucacuacaaccaaucaaaugacucuaccauuaaauugauagcaaugcuguacacaccacuuagggcuaauaaugcuggggaugaugucuucacagucucuugucggguccucacgagaccauccccugacuuugauuucauauuucugguaccaccaacaguugaaucaagaaccaaaccauuuaccguuccaaucuuaacuguugaggaaaugaccaacucaagauuccccauuccuuuggaaagguuguacacgggucccagcagugcuuuuguuguccagccacaaaacggcaggugcacgacugauggcgugcucuuaggcaccacccagcugucugcugucaacaucugcaccuuuagaggggaugucacucacauugcaggcucucgcaauuauacaaugaauuuggccucucaaaauuggaacaacuaugauccaacagaagaaaucccagccccccugggcaccccagauuucgugggaaagauccaagguaugcucacccaaaccacaagaagugauggcucgacccgcggccacaaggccacagugcucacugggagugccgacuucgccccaaaauugggcagaguccaauucgccacugacacagacaacgauuucgaaucuggccaaaacacgaaauucaccccaguuggcgucauccaggauggcuccacuacccaccgaaaugaaccucaacaauggguacucccaaauuacucagguagaacuggucauaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaauucuacacacuugcccccaugggaaauggaacggggcguagacguuaa

SEQ ID NO: 7244 - RNA, 1617 nt, Artificial Sequence
  VP1__Norovirus_and/or_Norovirus-like__AB663685
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggggaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaagguuugagucccagccagguuacuauguucccccacauaauaguagauguuaggcaauuggaaccuguguugaucccuuuaccugauguuaggaauaacuucuaccacuauaaucagucaaaugauucuaccauuaaauugauagcaaugcuguacacaccacuuagggccaauaaugcuggggaugaugucuucacagucucuugucgaguccucacgagaccauccccugauuuugauuuuauauuucuggugccacccacaguugagucaagagccaagccauucacugucccaaucuuaacuguugaagaaaugaccaauucaagauuccccauuccuuuggaaaaacuguucacgggucccagcagugccuuuguuguucaaccacaaaauggcagaugcacuacugauggcgugcucuuaggcaccacccaacugucuccugucaacaucugcaccuucagaggagaugucacccacauugcggguucccgcaauuacacaaugaauuuggccucucuaaauuggaacaauuacgacccaacagaagaaauuccagccccccugggaacuccagauuuugugggaaagauccaaggugugcucacucaaaccacaaagggagacggcucgacccggggccauaaagcuacaguuuacacugggagugccgacuuuacuccaaagcugggcaguguccaauuugguacugacacagaaaaugacuuugaaacucaccaaaacacaaaauucaccccaguaggugucauccaggaugguggcaccacccaccgaaaugaaccccaacaaugggugcucccaaguuauucagguagaaauguccauaauguacaccuagccccugcuguagcucccaauuuuccgggugaacaacuucuuuucuucagguccacuaugcccggauguagcggguaucccaacauggauuuggauugccugcucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccaacaugauuuggucaucccccccaauggcuauuuuagguuugauuccuggguuaaccaauucuacacacuugcccccaugggaaauggaacggggcguagacguuaa

SEQ ID NO: 7245 - RNA, 1617 nt, Artificial Sequence
  VP1__Norovirus_and/or_Norovirus-like__AB933746
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucguauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaccaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugcuuuuguuguucaaccacaaaacggcaggugcacgacugauggcgugcuccuagguacuacccaacugucuccugucaacaucugcaccuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagcuacaguguacacugggagcgccgaauuuuccccaaaacuggguagaguucaauuugccacugacacaaacaaugauuuugaugcuaaccaaaacacaaaguucaccccagucggugucauccaggauggugguacuacccaccgaaaugaaccccaacaaugggugcuuccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguguuguuugaguguaagcuucauaaaucaggcuauguuacaguggcccacacuggccaacaugauuugguuaucccccccaaugguuauuuuagauuugauuccugggucaaccaguucuacacacuugcccccaugggaaaugggacggggcguagacguuaa

SEQ ID NO: 7246 - RNA, 1617 nt, Artificial Sequence
  VP1__Norovirus_and/or_Norovirus-like__AB933701
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccgggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuacaaucagucaaaugauucuaccauuaaauugauagcaauguuguauacgccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaguuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaucuagccccugcuguagcccccacuuuuccgggugaacaacuucuuuucuucagguccacuaugcccggaugcagcggguaccccaacauggauuuggauugccugcucccccaggagugggugcagcacuucuaccaagaggcagcuccagcacaaucugauguggcucuauugagauuugugaauccugacacggguaggguccuguuugagugcaagcuucacaagucaggcuaugucacaguggcucacaccggccagcaugauuuggucaucccccccaaugguuauuuuagguuugauuccuggguuaaucaguucuacacacuugcccccaugggaaauggaacggggcguagacguuaa

SEQ ID NO: 7247 - RNA, 1617 nt, Artificial Sequence
  VP1__Norovirus_and/or_Norovirus-like__AB933686
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaggugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuuuuaucacuauaaucagucaaaugauucuaccauuaaauugauagcaauguuguacacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuauacaaugaauuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacguuaa

SEQ ID NO: 7248 - RNA, 1617 nt, Artificial Sequence
  VP1__Norovirus_and/or_Norovirus-like__AB933680
augaagauggcgucuaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaauucacaguauccccuagaaaugcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguggauguuaggcaauuggaaccuguguugauccccuuaccugauguuaggaauaacuucuaccauuauaaucagucaaaugauucuaccauuaaauugauagcaaugcuguauacaccacuuagggcuaauaaugcuggggaggaugucuucacagucucuugucgaguccucacgaggccauccccugauuuugacuuuauauuuuuggugccaccuacaguugagucaagaacuaaaccauuuacugucccaaucuuaacuguugaagaaaugaccaauucgagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaacuaugacccaacagaagaaauuccagccccucuaggaaccccagauuucgugggaaagauccaaggugugcucacucaaaccacaaagggagaugguucgacccguggucauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccgcccaccgaaaugaaccccaacaaugggugcucccaaguuauucagguagaaauguccaaaauguacaccuagccccugcuguagcccccacguuuccgggugaacaacuucuuuucuuuagguccacuaugcccggaugcagcggguaucccaacauggauuuggauugccuacucccccaggagugggugcaacacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7249 - RNA, 1617 nt, Artificial Sequence
  VP1__Norovirus_and/or_Norovirus-like__AB933672
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaauucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguggauguuaggcaauuggaaccuguguugauccccuuaccugauguuaggaauaacuucuaccacuauaaucagucaaaugauucuaccauuaaauugauagcaaugcuguauacaccacuuagggcuaauaaugcuggggaggaugucuucacagucucuugucgaguccucacgaggccauccccugauuuugacuuuauauuuuuggugccaccuacaguugagucaagaacuaaaccauuuacugucccaaucuugacuguugaagaaaugaccaauucgagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucauaauuacacaaugaauuuggcuucucuaaauuggaacaacuaugacccaacagaagaaauuccagccccucuaggaaccccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccgcccaccgaaaugaaccccaacaaugggugcucccaaguuauucagguagaaauguccaaaauguacaccuagccccugcuguagcccccacguuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7250 - RNA, 1617 nt, Artificial Sequence
  VP1__Norovirus_and/or_Norovirus-like__AB933664
augaagauggcgucgaaugacgccaccccaucugauggguccgcagccaaccucgucccggaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcgggugguuuugaagugcaggugauccucgcggggaacgcguucaccgccgggaaaauuauauuugcagcagucccaccaaauuuuccaacugaaggcuugagucccagccaggucacuauguucccccauauaauaguggauguuaggcaauuggaaccuguguugauccccuuaccugauguuaggaauaacuucuaccauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccacaaagcuacaguuuacacugggagugcccccuuuacuccaaagcugggcaguguucaauucaauacugauacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuuguaaauccagacacggguaggguucuguuugagugcaaacuucacaaaucaggcuaugucacaguggcucacaccggccagcaugauuuggucaucccccccaauggcuauuucagguuugauuccuggguuaaucaguucuacacacuugcccccaugggaaauggaacggggcguagacguuaa

SEQ ID NO: 7251 - RNA, 1617 nt, Artificial Sequence
  VP1__Norovirus_and/or_Norovirus-like__AB933662
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacaggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccauuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacgcuugcccccaugggaaauggaacggggcguagacguuaa

SEQ ID NO: 7252 - RNA, 1617 nt, Artificial Sequence
  VP1__Norovirus_and/or_Norovirus-like__AB933656
augaagauggcgucuaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuagggacuccagauuucgugggaaagauccaagguguacucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7253 - RNA, 1617 nt, Artificial Sequence
  VP1__Norovirus_and/or_Norovirus-like__EU921340
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaacgcguucaccgccggaaaaaucauauuugcggcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucgaguucucacgagaccaucccccgauuuugauuuuauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccagauuauucagguagagauagucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7254 - RNA, 1617 nt, Artificial Sequence
  VP1__Norovirus_and/or_Norovirus-like__KC962453
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaauauccccuagaaacgcuccaggugaaauacuauggagcgcgcccuuaggcccugauuugaaucccuaccuuucccauuuggccagaauguacaaugguuaugcaggugguuuugaagugcagguaauccuugcggggaaugcguucaccgccggaaaagucauauuugcagcagucccaccaaauuucccaacugaaggcuugagccccagccaggucacuauguuuccccauauaguaguagauguuaggcaacuggagccuguguugauccccuuacccgauguuaggaauaauuucuaccacuacaaucaaucaaaugaccccaccaucaaauugauagcaauguuguauacaccacuuagggcuaacaaugcuggggacgaugucuucacaguuucuugucgcguucucacgagaccaucccccgacuuugauuucauauuucuagugccacccacaguugaaucaagaacuaaaccauucucuaucccaguuuuaacuauugaggagaugaccaauucaagauuccccauuccucuggaaaaguuguucacgggucccagcagcgccuuuguuguucaaccacaaaacggcaggugcucgacugauggcgugcuccuagguacuacccaacugucuccugucaacaucugcaccuucagaggggaugucacccacaucgcagguagccacaacuacacaaugaauuuggcuucucaaaauuggaacaguuaugauccaacggaagaaaucccagccccuuuaggaacuccagauuucgugggcaagauucaaggugugcucacccaaaccacaagggcagauggcucgacccgcggccacaaagcuacaguacucacugggagcgccaacuuuacuccaaagcuggguagaauucaauuugccacugacacagacaaugauuuugaaacuaaccaaaacacaaaauucaccccagucggugucauccaggauggugauacugcccaccgaaaugaaccccaacagugggugcucccaaguuacucagguagaaacacucauaaugugcaucuggcccccgcuguagcccccacuuuuccgggugaacaacuucuuuucuucagguccaccauacccggaugcagcggguaccccaauauggauuuggacugucugcucccccaggaaugggugcaguucuucuaccaagaggcagccccagcacaaucugauguggcucugcuaagauuugugaauccagacacagguaggguuuuguuugaaugcaagcuucauaaaucaggcuacauuacaguggcccacacaggccaacaugauuugguuaucccccccaaugguuauuuuagauuugauuccugggucaaccaguucuacacgcuugcccccaugggaaauggaacggggcguagacguuaa

SEQ ID NO: 7255 - RNA, 1617 nt, Artificial Sequence
  VP1__Norovirus_and/or_Norovirus-like__KF712501
augaagauggcgucgaaugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaccauuauaaucagucaaaugauucuaccauuaaauugauagcaaugcuguauacaccacuuagggcuaauaaugcuggggaugaugucuuuacaguuucuugucgaguucucacgagaccaucccccgauuuugauuucauauuuuuagugccaccuacaguugaaucaagaacuaaaccauucucugucccaauuuuaacuguugaagaaaugaccaauucaagguuccccauuccuuuggaaaaguuguucacgggccccaguaguaccuuuguuguucaaccacaaaacggcaggugcacgacugauggcgugcuccuagguaccacccaacugucuccugucaacaucugcaccuucagaggggaugucacccacauuacaggcagucguaacuacacaaugaaccuggcuucccaaaauuggaacaguuaugacccaacagaagaaaucccagccccucuaggaacuccagauuucguggggaagauucaaggugugcucacucaaaccacaaggacagauggcucgacccgcggccacaaagcuacaguguacacugggagcgccgacuuuuccccaaaacuggguagaguucaauuugccacugacacagacaaugauuucgauacuaaccaaaacacuaaguucaccccagucgguguuauccaggaugguggcacuacccaccgaaaugaaccccaacaaugggugcucccaaguuacucaggcagaaacacucauaaugugcaccuggcccccgcuguagcccccacuuuuccgggugagcaacuccucuucuucagaucuaccaugccaggaagcagcggguaccccaacauggauuuggacugucugcucccccaggaaugggugcaguauuucuaccaggaagcagccccagcacaaucugauguggcucugcuaagauuugugaauccagacacagguaggguucuguuugaguguaagcuucauaaaucaggcuauguuacaguggcucacacuggucaacaugauuugguuaucccccccaaugguuauuuuagauuugauuccugggucaaccaguucuacacacuugccccuaugggaaaugggacggggcguagacguuaa

SEQ ID NO: 7256 - RNA, 1617 nt, Artificial Sequence
  VP1__Norovirus_and/or_Norovirus-like__JX459903
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuaggaacgcuccaggugaaauacuguggagcgcgccccuaggcccugauuugaauccuuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaccauuacaaucaaucaaaugaccccaccaucaaauugauagcaauguuguacacaccacuuagggcuaauaaugcuggggacgaugucuucacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaggcuacaguguacacugggagcgccgacuuugcuccaaaacuggguagaguucaauuugccacugacacagaccaugauuuugaugcuaaccaaaacacaaaguucaccccagucggugucauccaggauggugauacugcccaccgaaaugaaccccaacaaugggugcucccaaguuacucagguagaaauagucacaaugugcaccuggcccccacuguagcccccacuuuuccgggugagcaacuucucuucuuuagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuuuagguuugauucuugggucaaccaguucuacacacuugcccccaugggaaauggaacggggcguagacguuaa

SEQ ID NO: 7257 - RNA, 1617 nt, Artificial Sequence
  VP1__Norovirus_and/or_Norovirus-like__JX459629
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaguaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuucccaacugaaggcuugagucccagccaggucacuauguucccccacauaauaguggaugucaggcaauuggaaccuguguugauccccuuaccugauguuaggaauaauuucuaucacuauaaucagucgaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaauaucugcaccuucagaggggaugucacucacauugcagguucucguaauuacacaaugaauuuggcuucucuaaauuggaacaauuaugauccaacagaagaaauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuccauaaaucaggcuaugucacaguggcucacaccggccagcaugauuugguuaucccccccaaugguuauuucagguuugauuccuggguuaaucaauucuacacacuugcccccaugggaaauggaacggggcguagacguuaa

SEQ ID NO: 7258 - RNA, 1617 nt, Artificial Sequence
  VP1__Norovirus_and/or_Norovirus-like__JX445165
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaauaacuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaauaauauuuucagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccauaaaauugauagcaauguuguauacaccacuuagggcuaauaaugcuggggacgaugucuucacaguuucuugucgaguucucacgagaccaucccccgauuuugauuucauauuccuagugccacccacaguugaaucaagaacuaaaccauucucugucccaauucuaacuguugaggagaugaccaauucaagguuccccauuccuuuggaaaagcuguucacgggccccaguaguaccuuuguuguucaaccacaaaacggcaggugcacgacugauggcgugcuccuagguaccacccaacugucuccugucaacaucugcaccuucagaggggaugucacccauauuacaggcagucguaacuauacaaugaaucuggcuucccaaaauuggaacaguuaugacccaacagaagagaucccagccccucuagggacuccagauuucguggggaagauucaaggcgugcucacccaaaccacaaggacggauggcucgacccgcggccacaaagcuacaguguacacugggagcgccgaauuuuccccaaaacuggguagaguucaauuugccacugacacagacaaugauuuugaugccaaccaaaacacaaaguucaccccagucgguguuauccaggauggugguacuacccaccgaaaugaaccccaacaaugggugcuuccaaguuacucaggcagaaauacucacaaugugcaccuggcccccgcuguagcccccacuuuuccgggugagcagcuccucuuuuucaggucuaccaugcccggaugcagcggguaccccaacauggauuuggacugucuacucccccaggaaugggugcagcauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7259 - RNA, 1617 nt, Artificial Sequence
  VP1__Norovirus_and/or_Norovirus-like__HM635156
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuaggaacgcuccaggugaaauacuguggagcgcgccccugggcccugauuugaauccuuaccuuucucauuuggccagaauguacaacggcuaugccggcgguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuuuacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgauugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuugcuccaaaacuggguagaguucaauuugccacugacacagacaaugauuuugaugcuaaccaaaacacaaaguucaccccagucggugucauccaggaugguaauacugcccaccgaaaugaaccccaacaaugggugcucccaaguuacucagguagaaauagucacaacgugcaccuggcccccgcuguagcccccacuuuuccgggugagcaacuucucuucuucagaucuacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuuuagauuugauuccugggucaaccaguucuacacacuugcccccaugggaaauggaacggggcguagacguuaa

SEQ ID NO: 7260 - RNA, 1617 nt, Artificial Sequence
  VP1__Norovirus_and/or_Norovirus-like__JQ622197
augaagauggcgucgaaugacgccaacccaucugauggguccgcagccagccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaaguacaggugauccucgcggggaacgcguuuaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguggaaauguccauaauguacaccuagccccugcuguagcccccacuuuuccgggugaacaacuucuuuucuuuagguccacuaugcccgggugcagcggguauccaaacauggauuuggauugccuacucccccaggagugggugcagcauuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7261 - RNA, 1617 nt, Artificial Sequence
  VP1__Norovirus_and/or_Norovirus-like__JQ613520
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacaacugauggcgugcucuuaggcaccacccaacugucuccugucaacaucugcaccuucagaggggaugucacccacauugcaggcucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacagucuacacugggagugcccccuuuacuccaaagcugggcaguguucaauucaguacugacacagaaaaugauuuugaaacacaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggauguagcggguaucccaacauggauuuggauugccuacucccccaggagugggugcagcacuucuaucaagaggcagcuccagcacaaucugauguggcucuauugagauuugugaauccagacacggguaggguccuguuugagugcaaacuucauaaaucaggcuaugucacaguggcucauaccggccagcaugauuuggucauccccuccaaugguuauuuuagguuugauuccuggguuaaucaauucuacacacuugcccccaugggaaaugggacggggcguagacguuaa

SEQ ID NO: 7262 - RNA, 1617 nt, Artificial Sequence
  VP1__Norovirus_and/or_Norovirus-like__HQ456320
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggagccuguguugaucccccugccugauguuaggaauaauuuuuaucauuauaaucaaucaaaugaccccaccaucaaauugauagcaaugcuguauacaccacucagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucagccacaaaauggcagaugcacgacugauggcgugcucuuagguacuacccaacugucuccugucaacaucugcaccuucagaggggaugucacccacauugcagguacucaaaauuacacaaugaaccuggccucccaaaauuggaacaauuaugauccaacagaagaaaucccagccccucugggaaccccagauuuuguaggaaagauccaaggugugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagauucaccccagucgguguuguccaggaugguaguaccacccaccaaaaugaaccccaacaaugggugcucccaaacuauucagguagagauagucacaauguacaccuagccccugccguggcccccacuuucccgggugagcaacuucuuuucuuuagguccacuaugcccggaugcagcggguaucccaacaugaauuuggauugccuacucccccaggagugggugcaacacuucuaccaagagucagccccagcacaaucugauguggcacugcugagauuugugaauccagacacagguagggucuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7263 - RNA, 1617 nt, Artificial Sequence
  VP1__Norovirus_and/or_Norovirus-like__AB541353
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuugguaccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccaguuggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcgcuauugagauuugugaauccagacacggguaggguccuguuugagugcaagcuucacaaaucaggcuaugucacaguggcucacaccggccagcaugaucuggucaucccccccaaugguuauuuuagguuugauuccuggguuaaucaguucuacacacuugcccccaugggaaauggaacggggcguagacguuaa

SEQ ID NO: 7264 - RNA, 1617 nt, Artificial Sequence
  VP1__Norovirus_and/or_Norovirus-like__AB541348
augaagauggcgucgaaugacgccaacccaucugauggguccgcagccaaccucgucccagaggucaacaaugagguuauggcuuuggagcccguugucggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaaucauauuugcagcagucccaccaaauuuuccaacugaaggcuugagucccagccaggucacuauguucccccacauaauaguagauguuaggcaauuggaaccuguguugauccccuuaccugauguuaggaacaacuucuaucacuauaaucagucaaaugauucuaccauuaaauugauagcaaugcuguauacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuacgacccaacagaagaaaucccagccccucugggaacuccagauuuugugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccaacaugauuuggucaucccccccaaugguuauuuuagguuugacuccuggguuaaucaauucuauacacuugcccccaugggaaauggaacggggcguagacguuaa

SEQ ID NO: 7265 - RNA, 1617 nt, Artificial Sequence
  VP1__Norovirus_and/or_Norovirus-like__AB541339
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaggaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagacgguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguaacaccacccaccggaaugaaccccaacaaugggugcucccaaguuauucagguagaaauguccaaaauguacaccuagccccugcuguagcccccacuuuuccgggugaacaacuucuuuucuuuagguccacuaugcccggauguagcggguaccccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaaugggacggggcguagacguuaa

SEQ ID NO: 7266 - RNA, 1617 nt, Artificial Sequence
  VP1__Norovirus_and/or_Norovirus-like__AB541303
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcggguucucguaacuacacaaugaauuuggcugcucugaauuggaacaauuacgacccaacagaagaaauuccagccccucuaggaaccccagauuucgugggaaagauccaaggugugcucacucaaaccacaaaggcagauggcucgacccguggccauaaagcuacaguuuacacugggagugccgucuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7267 - RNA, 1617 nt, Artificial Sequence
  VP1__Norovirus_and/or_Norovirus-like__GQ246799
augaagauggcgucgaaugacgccaacccaucugauggguccgcagccaaccucgucccagagaucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaagugauccccgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauucuaccauuaaauugauagcaaugcuguacacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagugccuuuguuguucaaccacaaaauggcagaugcacgacugauggcgugcucuuagguaccacccaacugucuccugucaacaucugcaccuucagaggggaugucacccacauugcggguucucguaauuacacaaugaauuuggccucucuaaauuggaacaauuaugacccaacagaagagauuccagccccucugggaacuccagauuucgugggaaagauccaaggugugcucacucaaaccacaaaggaagauggcucgacccggggccacaaagcuacaguuuacacugggagugccgacuucacuccaaagcugggcaguguucaauuugguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccaacaugauuuggucaucccccccaaugguuauuuuagguuugauuccuggguuaaucaguucuacacacuugcccccaugggaaauggaacggggcguagacguuaa

SEQ ID NO: 7268 - RNA, 1617 nt, Artificial Sequence
  VP1__Norovirus_and/or_Norovirus-like__EU876886
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaccccuaccuuucccauuuggccagaauguacaaugguuaugcagguggcuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgauguuuuuacaguuucuugucgaguucucacgagaccaucccccgauuuugauuucauauuuuuagugccacccacaguugagucaagaaccaaaccauucucugucccaauuuuaacuguugaggagaugaccaauucaagauuccccauuccuuuggaaagguuguuuacgggucccagcagugccuuuguuguucaaccacaaaauggcaggugcacgacugauggcgugcuccuagguacuacccaacugucuucugucaacaucugcaccuucagaggggaugucacccacauugcaggcacucaagaauacacaaugaaucuggccucccaaaacuggaacaauuaugacccaacagaagaaaucccagccccucugggaacuccagauuucguggguaagauccaaggcgugcucacccaaacaacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauggucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaaugguuauuuuagauuugauuccugggucaaccaguucuacacacuugcccccaugggaaauggaacggggcguagacguuaa

SEQ ID NO: 7269 - RNA, 1617 nt, Artificial Sequence
  VP1__Norovirus_and/or_Norovirus-like__AB385630
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaaggaagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaucgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagauuugauuccuggguuaaucaauucuacacacuugcccccaugggaaauggaacggggcguagacguuaa

SEQ ID NO: 7270 - RNA, 1617 nt, Artificial Sequence
  VP1__Norovirus_and/or_Norovirus-like__KU182483
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaauggcuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauuuucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggccacaaagccacagugagcacuggaaguguccacuuuaccccaaagcugggcaguguucaauucucuacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcucacacuggucaacaugauuugguuaucccccccaauggcuauuuuagauuugauuccugggucaaccaauucuacacacuugcccccaugggaaauggagcggggcguagacguuaa

SEQ ID NO: 7271 - RNA, 1617 nt, Artificial Sequence
  VP1__Norovirus_and/or_Norovirus-like__AB665364
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaaugcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaguucaguacugauacagaaaaugauuuugaaacccaccaaaacacaaaauucaccccagucggugucauccaggaugguagcaccacccaccgaaaugaaccccaacaauggguacucccaaguuauucagguagaaauguccaaaauguacaccuagccccugccguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7272 - RNA, 1617 nt, Artificial Sequence
  VP1__Norovirus_and/or_Norovirus-like__AB663686
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaccugaaucccuaccuaucucauuuggccagaauguauaaugguuaugcaggugguuuugaggugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaugaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaguuggaacaauuaugacccaacagaagaaauuccagccccucuaggaaccccagauuuugugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacguuaa

SEQ ID NO: 7273 - RNA, 1617 nt, Artificial Sequence
  VP1__Norovirus_and/or_Norovirus-like__AB933702
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccagggugugcucacccaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaucaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7274 - RNA, 1617 nt, Artificial Sequence
  VP1__Norovirus_and/or_Norovirus-like__AB933685
augaagauggcgucuaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuucccaacugaaggccugagucccagccagguuacuauguucccccacauaauaguggauguuaggcaauuggaaccuguauugauccccuuaccugauguuaggaauaacuuuuaucauuauaaucagucaaaugauucuaccauuaaauugauagcaaugcuguauacaccacuuagggcuaauaaugcuggggaagaugucuucacaguuucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagugccuuuguuguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccuuuaggaaccccagauuucgugggaaagauccaagguaugcucacucaaacuacaaagggagauggcucgacccguggccauaaagcuacaguuuacacugggagugcccccuuuacuccaaagcugggcaguguucgguucaguacugacacagaaaaugauuuugaaauucaccaaaauacaaaauucacuccagucggugucauccaggaugguagcaccacccaccgaaaugaaccccaacaauggguacucccaaguuauucagguagagaugcccauaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguucuguuugagugcaaacuccauaaaucaggcuaugucacaguggcucacaccggccagcaugauuuggucaucccccccaaugguuauuuuagguuugauuccuggguuaaucaauucuauacacuugcccccaugggaaauggaacggggcguagacguuaa

SEQ ID NO: 7275 - RNA, 1617 nt, Artificial Sequence
  VP1__Norovirus_and/or_Norovirus-like__AB933645
augaagauggcgucgaaugacgccaccccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguaggcguuaa

SEQ ID NO: 7276 - RNA, 1617 nt, Artificial Sequence
  VP1__Norovirus_and/or_Norovirus-like__LC005706
augaagauggcgucgaaugacgccaacccaucugauggguccgcagccaaccucgucccagaggucaacaaugagguuauggcuuuggagcccguugucggugccgcuauugcagcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccaucccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaauaauuaugacccaacagaagaaauuccagccccccuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaaugcccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcgcaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7277 - RNA, 1617 nt, Artificial Sequence
  VP1__Norovirus_and/or_Norovirus-like__KM198562
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugagauacuauggagcgcgcccuuaggcccugaucugaaucccuaccuaucccauuuggccagaauguauaaugguuaugcagguggcuuugaagugcaggugauccucgcggggaacgcguucaccgccggaaaaauuauauuugcagcaguuccaccaaauuuuccaacugaaggcuugagccccagccagguuacuauguucccccauauaauaguagauguuaggcaacuggaaccuguguugauccccuuaccugauguuaggaauaacuucuaucauuauaaucagucaaaugauuccaccauuaaauugauagcaaugcuguacacaccacuuagggcuaauaaugcuggggaagaugucuucacagucucuugucgaguucucacgaggccauccccugauuuugauuuuauauuuuuggugccacccacaguugagucaagaacuaaaccauuuacugucccaaucuuaacuguugaagaaaugaccaauucaagauuccccaucccuuuggaaaaguuguucacgggccccagcggugccuuuauuguucaaccacaaaaugguaggugcacgacugauggcgugcucuuaggcaccacccaacugucuccugucaacaucugcaccuucagaggggaugucacccacauugcagguucucgcgauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccacaaagcaacaguuuacacugggagugcccccuucacuccaaagcugggcaguguucaauucaguacugacacagaaaaugauuuugaagcucaccaaaacacaaaauucaccccagucggugucauccaggauggugguaccacccaccgaaaugaaccccagcaaugggugcucccaaguuauucagguagagauguccacaauguacaccuggccccugcuguagcccccacuuuuccgggugaacaacuucucuucuucagguccacuaugcccggaugcaguggguauccuaacauggauuuggauugccuacucccucaggagugggugcagcacuucuaccaagaggcagcuccagcacaaucugauguggcucuauugagauuugugaauccagacacggguaggguccuguuugagugcaaacuucauaaaucagguuaugucacaguggcucacaccggccagcaugauuuggucauccccccuaauggcuauuuuagguuugauuccuggguuaaccaauucuacacacuugcccccaugggaaauggaacggggcguagacguuaa

SEQ ID NO: 7278 - RNA, 1617 nt, Artificial Sequence
  VP1__Norovirus_and/or_Norovirus-like__KC409311
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaccccuaccuuucccauuuggccagaauguacaaugguuaugcaggugguuuugaagugcagguaguccucgcggggaacgcguucaccgccggaaaaauuauauuugcagcagucccaccaaauuucccaacugaaggcuugagccccagccaggucaccauguucccccacaugauaguagauguuaggcaauuggaaccuguguugaucccccuacccgauguuaggaauaauuucuaucacuauaaccaaucaaaugaccccaccaucaaauugauagcaauguuguauacaccacuuagggccaauaaugcuggggacgaugucuucacagucucuugucggguucucacgaggccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcacuuucagaggggaugucacccauauuacagguagucauaacuacacaaugaauuuggcuacucaaaauuggaacaguuaugacccaacagaagaaaucccagccccucugggaacuccagauuucguggggaagauucaaggugugcucacccaaaccacaagggcagauggcucgacccgcggccacaaagccacaguguacacugggagcgccgauuuugcuccaaaacuggguagaguucaauuugccacugacacaaacaaugaucuuggugccaaccaaaacacaaaguucaccccagucggugucauccaggaugguggcacugcccaccgaaaugaaccccaacaaugggugcucccaaguuacucaggcagaaauagucauaaugugcaccuggcccccgcuguagcccccacuuuuccgggugagcaacuucucuucuuuagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacuguggcucacacuggccaacaugauuugguuaucccccccaaugguuauuuuagauuugauuccugggucaaccaguucuacacacuugcccccaugggaaauggaacggggcguagacguuaa

SEQ ID NO: 7279 - RNA, 1617 nt, Artificial Sequence
  VP1__Norovirus_and/or_Norovirus-like__KC409263
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcaguuccaccaaauuuuccaacugaaggcuugagccccagccagguuacuauguucccccacauaauaguagauguuaggcaacuggagccuguguugauccccuuaccugauguuaggaauaacuucuaucauuauaaucagucaaaugauucuaccauuaaacugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccaucccuuuggaaaaguuguucacgggccccagcggugccuuuguuguucaaccacaaaaugguagaugcacgacugauggcgugcucuuaggcaccacccaacugucuccugucaacaucugcaccuucagaggggaugucacccacauugcagguucucgcgauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguccaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7280 - RNA, 1617 nt, Artificial Sequence
  VP1__Norovirus_and/or_Norovirus-like__JX459900
augaagauggcgucgaaugacgccaacccaucugauggguccgcagccaaccucgucccagaggucaacaaugagguuauggcuuuggagcccguuguuggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaucccuaccuaucucauuuggccagaauguauaaugguuaugcaggugguuuugaagugcaggugauccucgcggggaacgcguucaccgcuggaaaaauuauauuugcagcagucccaccaaauuuuccaacugaaggcuugagucccagccagguuacuauguucccccauauaauaguagauguuaggcaauuggaaccuguguugauccccuuaccugauguuagaaauaacuucuaucauuauaaucagucaaaugauucuaccauuaaauugauagcaaugcuguacacaccacuuagggcuaauaaugcuggggaugaugucuuuacaguuucuugucgaguucucacgagaccaucccccgauuuugauuucauauuuuuagugccaccuacaguugaaucaagaacuaaaccauucucugucccaauuuuaacuguugaagaaaugaccaauucaagguuccccauuccuuuggaaaaguuguucacgggccccaguaguaccuuuguuguucaaccacaaaacggcaggugcacgacugauggcgugcucuuagguaccacccaacugucuccugucaacaucugcaccuucagaggggaugucacccacauugcaggcagucguaacuacacaaugaaucuggcuucccaaaauuggaacaguuaugacccaacagaagaaaucccagccccucuaggaacuccagauuucguggggaagauucaaggugugcucacccaaaccacaaggacagauggcucgacccgcggucacaaagcuacaguguacacugggagugccgacuuuucuccaaaacuggguagaguucaauuugccacugacacagacaaugauuucgaugcuaaccaaaacacaaaguucaccccagucggcguuauccaggauggaaauacugcccaccgaaaugaaccccaacaaugggugcucccaagcuacucaggcagaaacacccauaaugugcaccuggcccccgcuguagcccccacuuuuccgggugagcaacuccucuucuucagaucuaccaugcccggaugcagcggguaccccaacauggauuuggacugucugcucccccaggaaugggugcaguauuucuaccaggaagcagccccagcacaaucugauguggcucugcuaagauuugugaauccagacacagguaggguccuguuugaguguaagcuucauaaaucaggcuauguuacaguggcucacacuggccaacaugauuugguuaucccccccaaugguuauuuuagauuugacuccugggucaaccaguucuacacacuugcccccaugggaaaugggacggggcguaggcguuaa

SEQ ID NO: 7281 - RNA, 1617 nt, Artificial Sequence
  VP1__Norovirus_and/or_Norovirus-like__JX459617
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgccccuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacgaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaagucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7282 - RNA, 1617 nt, Artificial Sequence
  VP1__Norovirus_and/or_Norovirus-like__GQ845366
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacaucugcaccuucagaggggaugucacccacauugcaggcucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacagucuacacugggagugcccccuuuacuccaaagcugggcaguguccaauucaguacugacacagaaaaugauuuugaaacucaccaaaacacaaaauucaccccagucggugucauccaggaugguggcaccacccaccgaaaugaaccccaacaaugggugcucccaaauuauucagguagaaaugucccuaauguacaccuagccccugcuguagcccccacuuuuccgggugaacaacuucuuuucuuuagguccacuaugcccggauguagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucauacuggccagcaugauuuggucauccccuccaaugguuauuuuagguuugauuccuggguuaaucaauucuacacacuugcccccaugggaaaugggacggggcguagacguuaa

SEQ ID NO: 7283 - RNA, 1617 nt, Artificial Sequence
  VP1__Norovirus_and/or_Norovirus-like__GQ845345
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauaugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaacuaaaccauucucugucccaauuuuaacuguugaggagaugaccaauucaagguuccccauuccuuuggaaaagcuguucacgggccccaguagugccuuuguuguucaaccacaaaacggcaggugcacgacugauggcgugcuccuagguacuacccaacugucuccugucaacaucugcaccuucagaggggaugucacccauauugcaggcagucguaacuacacaaugaaucuggcuucccaaaauuggaauaguuaugacccaacagaagaaaucccagccccucuaggaacuccagauuucguggggaagauucaaggugugcucacccaaaccacaaggacggauggcucgacccgcggccacaaagcuacaguguacacugggagcgccgacuuuucuccaaaacuggguagaguucaauuugccacugacacagacaaugauuuuguugcuaaccaaaacacaaaguucaccccagucgguguuauccaggaugguaauacugcccaccgaaaugaaccccaacaaugggugcucccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacucgcccccaugggaaaugggacggggcguagacguuaa

SEQ ID NO: 7284 - RNA, 1617 nt, Artificial Sequence
  VP1__Norovirus_and/or_Norovirus-like__GQ845341
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaccccuaccuaucucauuuggccagaauguauaaugguuaugcaggugguuuugaagugcaggugauccucgcggggaacgcguucaccgccggaaaaauuauauuugcagcagucccaccaaacuucccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggcuaauaaugcuggggacgaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcuuuuaggcaccacccaacugucuccugucaacaucugcaccuucagaggggaugucacccacauugcaggcucucgugauuacacaaugaauuuggcuucucuaaauuggaacaauuacgacccaacagaagaaauuccagccccucuaggaacuccagauuucgugggaaagauccaaggugugcucacucaaaccacagagggggauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguaguaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccagcaugauuuggucaucccccccaauggcuauuuuagguuugauuccuggguuaaucaguucuacacacuugcccccaugggaaauggaacggggcguagacguuaa

SEQ ID NO: 7285 - RNA, 1617 nt, Artificial Sequence
  VP1__Norovirus_and/or_Norovirus-like__HQ005292
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggaucagaaauaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugacggcgugcuccuagguaccacucaacugucuccugucaacaucugcaccuucagaggggaugucacccauauugcagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuuucuccaaaacugggcagaguucaauuugccacugacacagacaaugauuuugaugcuaaccaaaacacaaaguucaccccagucggugucauccaggaugguaauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugccugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcccacaccggccaacaugauuugguuaucccccccaaugguuacuuuagauuugauuccugggucaaccaguucuacacacuugcccccaugggaaauggaacggggcguagacguuaa

SEQ ID NO: 7286 - RNA, 1617 nt, Artificial Sequence
  VP1__Norovirus_and/or_Norovirus-like__HQ456321
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuuuuaucacuacaaucaaucaaaugaccccaccaucaaauugauagcaaugcuguauacaccacucagggcuaacaaugcuggggacgaugucuucacagucucuugucgaguucucacgagaccaucccccgauuuugauuucauauuuuuggugccacccacaguugagucgagaacuaaaccauucucugucccaaucuuaacuguugaggagaugaccaauucaagauucccuauuccuuuggaaaaguuguucacgggucccagcagugccuuuguuguucagccacaaaauggcagaugcacgacugauggcgugcucuuagguacuacccaacugucuccugucaacaucugcaccuucagaggggaugucacccacauugcggguacucaaaauuacacagugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagguucaccccagucgguguuguccaggaugguaguaccacccaccaaaaugaaccccaacaaugggugcucccaaacuauucagguagagauagucacaauguacaccuagccccugccguggcccccacuuucccgggugagcaacuucuuuucuuuagguccacuaugcccggaugcagcggguaucccaacaugaauuuggauugccuacucccccaggagugggugcaacacuucuaccaagagucagccccagcacaaucugauguggcacugcugagauuugugaauccagacacagguagggucuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7287 - RNA, 1617 nt, Artificial Sequence
  VP1__Norovirus_and/or_Norovirus-like__AB541326
augaagauggcgucgaaugacgccaacccaucugauggguccgcagccaaccucgucccagaggucaacaaugagguuauggcuuuggagcccguugucggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccuugcggggaacgcguucaccgccggaaaaaucauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauuacggguucucguaauuacacaaugaauuuggccucucuaaauuggaacaauuacgacccaacagaagaaaucccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccaacaugauuuggucaucccccccaaugguuauuuuagguuugacuccuggguuaaucaauucuauacacuugcccccaugggaaauggaacggggcguagacguuaa

SEQ ID NO: 7288 - RNA, 1617 nt, Artificial Sequence
  VP1__Norovirus_and/or_Norovirus-like__AB541251
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuugguuucucuaaauuggaacaauuaugacccaacagaagaaauuccagccccucuagggacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucaggcagaaauguccauaauguacaccuagccccugcuguagcccccacuuuuccgggugaacaacuucuuuucuuuagguccacuaugcccggauguagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcuuacaccggccagcaugauuuggucaucccccccaaugguuauuuuagguuugauuccuggguuaaucaauuuuacacacuugcccccaugggaaauggaacggggcguagacguuaa

SEQ ID NO: 7289 - RNA, 1617 nt, Artificial Sequence
  VP1__Norovirus_and/or_Norovirus-like__AB541241
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaguucacaguauccccuagaaacgcuccaggugaaauacuauggagcgcgcccuuaggccccgaucugaaucccuaccuaucucauuuggccagaauguauaaugguuaugcaggugguuuugaagugcaggugauccucgcggggaacgcguucaccgccggaaaaauuauauuugcagcaguuccaccaaacuuuccaacugaaggcuugagccccagucaggucacuauguucccccacauaauaguagauguuaggcaacuggaaccuguauugauccccuuaccugauguuaggaauaacuucuaucauuauaaucagucaaaugauucuaccauuaaauugauagcaaugcuguauacaccacuuagggcuaauaaugcuggggaagaugucuucacagucucuugccgaguccucacgaggccauccccugauuuugauuuuauauuuuuggugccaccuacaauugagucaagaacuaaaccauuuacugucccaaucuuaacuguugaagaaaugaccaauucaagauuccccauuccuuuggaaaaguuguucacgggucccagcggugccuuugucguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagagguguccauaauguacaccuggccccugcuguagcccccacuuuuccgggugaacaacuucuuuucuucagguccacuaugcccgggugcaguggguaucccaacauggauuuggauugccuacucccccaggagugggugcagcacuucuaccaagaggcagcuccagcacaaucugauguggcucuauugagauuugugaauccagacacggguaggguccuguucgagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacguuaa

SEQ ID NO: 7290 - RNA, 1617 nt, Artificial Sequence
  VP1__Norovirus_and/or_Norovirus-like__AB541216
augaagauggcgucgaaugacgccaacccaucugauggguccgcggccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuacuuaucucauuuggccagaauguauaaugguuaugcaggugguuuugaagugcaggugauccucgcggggaacgcguucaccgccggaaagauuauauuugcagcagucccaccaaauuuuccaacugaaggcuugagucccagccaggucacuauguucccccacauaauaguagauguuaggcaauuggaaccuguguugauccccuugccugauguuaggaauaacuucuaccacuauaaucagucaaaugauucuaccauuaaauugauagcaaugcuguauacaccacuuagggccaauaaugcuggggaagaugucuucacggucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaaugugcaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccaacaugaucuggucaucccccccaauggcuauuuuagguuugauuccuggguuaaucaauucuacacacuugcccccaugggaaauggaacggggcguagacguuaa

SEQ ID NO: 7291 - RNA, 1617 nt, Artificial Sequence
  VP1__Norovirus_and/or_Norovirus-like__EU876885
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccacuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgauguuuucacaguuucuugucgaguucucacgagaccaucccccgauuuugauuucauauuuuuagugccacccacaguugagucaagaaccaaaccauucucugucccaauuuuaacuguugaggagaugaccaauucaagauuccccauuccuuuggaaagauuguuuacgggucccagcagugccuuuguuguucaaccacaaaauggcaggugcacgacugauggcgugcuccuagguacuacccaacugucuccugccaacaucugcaccuucagaggggaugucacccacauugcaggcacucaagaauacacaaugaaucuggccucccaaaacuggaacaauuaugacccaacagaagaaaucccagccccucugggaacuccagauuucguggguaagauccaaggcgugcucacccaaacaacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguggcaccacccaccaaaaugaaccccaacaauggguacucccaaauuauucagguagagauggucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccggacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7292 - RNA, 1617 nt, Artificial Sequence
  VP1__Norovirus_and/or_Norovirus-like__AB447435
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucaguuaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccaguggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacccaccaaaacacaaaauucaccccagucggugucauccaggaugguagcaccacccaccgaaaugaaccccaacaaugggugcucccaaguuacucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7293 - RNA, 1617 nt, Artificial Sequence
  VP1__Norovirus_and/or_Norovirus-like__KX354073
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggccccgaucugaaucccuacuuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccauauaauaguagauguuaggcaauuggaaccuguguugauccccuuaccugauguuaggaauaauuucuaucauuauaaucagucaaaugauuccaccauuaaguugauagcaaugcuguauacaccacuuagggccaacaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagcgccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucuuuaaauuggaacaauuaugacccaacagaagagauuccagccccucuggggacuccagauuucgugggaaagauccaaggugugcucacucaaaccacaaagggagauggcucgacccggggucauaaagcuacaguuuacacugggagugccgacuuuacuccaaagcugggcaguguucaauuugcuacugacacagaaaaugauuuugaaacucaccaaaacacaagauucacaccagucggugucauccaggaugguagcaccacccaccgaaaugaaccccaacaaugggugcuuccaaguuauucagguagaaauguccauaauguacaccuagccccugcuguagcccccaauuuuccgggugaacaacuucuuuucuucagguccaccaugcccggaugcagcggguaucccaacauggacuuggauugccuacucccccaggagugggugcagcacuucuaccaagaggcagcuccagcacaaucugauguggcucuauugagauuugugaauccagacacggguagggucuuguuugagugcaagcuucauaaaucaggcuaugucacaguggcucacaccggccaacaugauuuggucaucccccccaaugguuauuuuagguuugauuccuggguuaaucaauucuauacacuugcccccaugggaaauggaacggggcguagacgauaa

SEQ ID NO: 7294 - RNA, 1617 nt, Artificial Sequence
  VP1__Norovirus_and/or_Norovirus-like__KX353981
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguaucaccuagaaacgcuccaggugaaauacuauggagcgcgcccuuagguccugaucugaaucccuaccuaucccauuuggccagaauguauaaugguuaugcaggugguuuugaagugcaggugauccucgcggggaacgcguucaccgccggaaaaaucauauuugcagcagucccaccaaauuuuccaacugaaggcuugagucccagccaggucacuauguucccccacauaauaguggauguuaggcaauuggaaccuguguugauccccuuaccugauguuaggaacaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuucuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggauguuacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcaguggguaccccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuugguuaucccccccaaugguuauuuuagguuugauuccuggguuaaucaauucuacacacuugcccccaugggaaauggaacggggcguagacguuaa

SEQ ID NO: 7295 - RNA, 1617 nt, Artificial Sequence
  VP1__Norovirus_and/or_Norovirus-like__KU182479
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuucuaucauuacaaucaaucaaaugaccccaccaucaaauugauagcaaugcuguacacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuggguacuacccaacugucuccugucaacaucugcaccuucagaggggaugucacccacauugcaggugcucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggccacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcucacacuggccaacaugauuugguuaucccccccaauggcuauuuuagauuugauuccugggucaaccaauucuacacacuugcccccaugggaaauggugcggggcguagacguuaa

SEQ ID NO: 7296 - RNA, 1617 nt, Artificial Sequence
  VP1__Norovirus_and/or_Norovirus-like__KU182478
augaagauggcgucgaaugacgccaccccaucugauggguccacagccaaccucgucccagaggucaacaaugagguuauggcuuuggagcccguuguuggugccgcgauugcggcgccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaauggcuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauuuucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggccacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggucaacaugauuugguuaucccccccaauggcuauuuuagauuugauuccuggaucaaccaauucuacacacuugcccccaugggaaauggagcggggcguagacguuaa

SEQ ID NO: 7297 - RNA, 1617 nt, Artificial Sequence
  VP1__Norovirus_and/or_Norovirus-like__AB972501
augaagauggcgucgaaugacgccaacccaucugauggguccgcagccaaccucgucccggaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauuuuugcagcagucccaccaaauuuuccaacugaaggcuugagucccagccaggucacuauguucccccauauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuauacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucgguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugaacaacuucuuuucuuuagguccacuaugcccggaugcagcggguaucccaacauggauuuggauugccugcucccccaggagugggugcagcacuuuuaccaagaggcagcuccagcacaaucugauguggcucuauugagauuuguaaauccagacacggguaggguucuguuugagugcaaacuucacaaaccaggcuaugucacaguggcucacaccggccagcaugauuuggucaucccccccaauggcuauuucagguuugauuccuggguuaaucaguucuacacacuugcccccaugggaaauggaacggggcguagacguuaa

SEQ ID NO: 7298 - RNA, 1617 nt, Artificial Sequence
  VP1__Norovirus_and/or_Norovirus-like__KR904214
augaagauggcgucgagugacgccaacccaucuguuggguccgcagccaaccucgucccagaggucaacaaugagguuauggcucuggagcccguuguuggugccgccauugcggcaccuguggcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccacuuggccagaauguacaaugguuaugcaggugguuuugaagugcugguaauccucgcggggaacgcguucaccgccgguaagaucauuuuugcagcagucccaccaaauuucccaacugaaggcuugagccccagccaggucacuauguucccccauauaauaguagauguuaggcaacuagaaccuguguugauucccuuacccgauguuaggaauaauuucuaccauuauaaucaaucaaaugaccccacuaucaaguugauagcaauguuguauacaccacuuagggcuaauaaugcuggggacgacgucuucacaguuucuugucggguucucacgagaccauccccugauuuugauuucauauuuuuagugccacccacaguugagucaagaacuaaaccauucucugucccaauuuuaacuguugaggagaugaccaauucaagauuccccauuccucuggaaaaguuguucacgggucccagcagugccuuuguuguucaaccacaaaacgguaggugcacgacugacggcgugcuccuagguacuacccaauugucuccugucaacaucugcaccuucagaggggaugucacccauacuacagguagucacaacuacacaaugaauuuggccacucaaaauuggaacaguuaugacccaacagaagaaaucccagccccucuaggaacuccagauuucguggggaagauucaagguguacucacccaaaccacaaagacagauggcucgacacgcggccacaaagcuacaguguacacugggagcgccgacuuugcuccaaaauuggguagaguucaauuugccacugacacagacaaugauuuugaagcuaaccaaaacacgaaguucaccccagucggugucauccaggauggugguacugcccaccgaaaugaaccccaacagugggugcucccaaguuacucaggcagaaauacucacaaugugcauuuggcccccgcuguagcccccacuuuuccgggugagcaacuucucuuuuucagauccacuaugcccggaugcagcggguaucccaacauggauuuggacugccugcucccccaggaaugggugcaguacuucuaccaagaggcagccccagcacaaucugauguggcucuacuaagauuugugaacccagacacagguaggguuuuguuugaguguaagcuucauaaaucaggcuauguuacaguagcucacacugguccacaugauuugguuaucccccccaaugguuauuuuagauuugauuccugggucaaccaguucuacacacuugcccccaugggaaaugggacggggcgcagacgauaa

SEQ ID NO: 7299 - RNA, 1617 nt, Artificial Sequence
  VP1__Norovirus_and/or_Norovirus-like__AB933758
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaauaacuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucaccauguucccccacauaauaguagauguuaggcaauuggaaccuguguugauccccuuacccgacguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcguccuccuagguacuacccaacugucuccugucaacaucugcaccuucagaggggaugucacccacauugcaggcagucauaacuacacaaugaaucuggcuucccaaaauuggaacaguuaugacccaacagaagaaaucccagccccucuaggaacuccagauuucguggggaagauucaagguguacucacccaaaccacaaggacggauggcuccacccgcggccacaaagccacaguguacacugggagcgccgaauuuuccccaaaacuggguagaguucaauuugccacugacacaaacaaugauuuugaugcuaaccaaaacacaaaguuuaccccagucgguguuauccaggauggugguacuacccaccgaaaugaaccccaacaaugggugcuuccaaguuacucaggcagaaauacucauaaugugcaccuggcccccgcuguagcucccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcugagauuugugaacccagacacagguaggguuuuguuugaguguaagcuucauaagucgggcuauguuacaguggcucacacuggccaacaugauuugguuaucccccccaaugguuauuuuagauuugauuccugggucaaucaguucuacacacuugcccccaugggaaacgggacggggcguagacguuaa

SEQ ID NO: 7300 - RNA, 1617 nt, Artificial Sequence
  VP1__Norovirus_and/or_Norovirus-like__AB933698
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguggauguuaggcaauuggaaccuguguugauccccuuaccugauguuaggaauaauuucuaucauuauaaucagucaaaugauucuacuauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggagaaauuguucacgggucccagcggugccuuuguuguucaaccgcaaaauggcagaugcacgacugauggcgugcuccuaggcaccacccaacugucuccugucaacauuugcaccuucaaaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccacaaagcuacagucuacacugggagugcucccuuuacuccaaagcugggcaguguucaauucaguacugauacagaaaaugauuuugaaacucaccaaaacacaaaauucaccccagucggugucauccaggaugguggcaccacccaucaaaaugaaccccaacaaugggugcucccaaguuauucagguagagaugucccuaauguacaccuagccccugcuguggcccccacuuucccgggugaacaacuucuuuucuuuagguccaccaugcccggaugcagcggguaucccaacaugaauuuggacugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugaucuggucaucccccccaaugguuauuuuagguuugauuccuggguuaaucaauucuacacacucgcccccaugggaaauggaacggggcguagacguuaa

SEQ ID NO: 7301 - RNA, 1617 nt, Artificial Sequence
  VP1__Norovirus_and/or_Norovirus-like__KJ678141
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuuuauauuucuagugccacccacaguugagucaagaacuaaaccauucucugucccaguuuuaacuguugaggagaugaccaauucaagauuccccauuccuuuggaaaagcuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucaaggcgugcucacccaaaccacaaggacaaauggcucaacacgcggccacaaagccacaguguacgcugggagcgccaacuuugcuccaaaacuggguagaguucaauuugaaacugacacagaccaugaucuugaagcuaaccaaaacacaaaauucaccccaguuggugucauccaagaugguaacaccacccaccgaaaugaaccccaacagugggugcucccaaguuacucaggcagaaguacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucgggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7302 - RNA, 1617 nt, Artificial Sequence
  VP1__Norovirus_and/or_Norovirus-like__EU921347
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguacuccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaaccaaaccauucucugucccaauuuuaacuguugaggagaugaccaauucaagauuccccauuccuuuggaaagguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaaaauucaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggauggugguaccacccaccaaaaugaaccccaacaaugggugcucccagauuauucagguagagauagucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7303 - RNA, 1617 nt, Artificial Sequence
  VP1__Norovirus_and/or_Norovirus-like__JX459628
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaaccccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucauaccggccagcaugacuuggucaucccccccaauggcuauuuuagguuugauuccuggguuaaucaauucuacacacuugcccccaugggaaauggaacggggcguagacguuaa

SEQ ID NO: 7304 - RNA, 1617 nt, Artificial Sequence
  VP1__Norovirus_and/or_Norovirus-like__JQ613564
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaauaacuuuguacaagccccugguggagaguuuacaguauccccuagaaacgcuccaggugaaauacuauggagcgcgcccuuagguccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucaccauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcguccuccuagguacuacccaauugucuccugucaacaucugcaccuucagaggggaugucacccacacugcaggcagucauaacuacacaaugaaucuggcuucccaaaauuggaacaguuaugacccaacagaagaaaucccagccccucuaggaacuccagauuucguggggaagauccaagguguacucacccaaaccacaagggcggauggcucuacccgcggccacaaagccacaguguacacugggagcgccgaauuuuccccaaaacuggguagaguucaauuugccacugacacagacaaugauuuugaugcuaaccaaaacacaaaguucaccccagucgguguuauccaggauggugguacuacccaccgaaaugaaccccaacaaugggugcuuccaaguuacucaggcagaaauacucauaaugugcaccuggcccccgcuguagcucccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucgggcuauguuacaguggcucacacuggccaacaugauuugguuaucccccccaaugguuauuuuagauucgauuccugggucaaucaguucuacacacuugcccccaugggaaaugggacggggcguagacguuaa

SEQ ID NO: 7305 - RNA, 1617 nt, Artificial Sequence
  VP1__Norovirus_and/or_Norovirus-like__GQ845332
augaagauggcgucgaaugacgccaacccaucuaauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaacaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcagguucucguaauuacacaaugaauuuggcuucucuaaacuggaacaauuaugacccaacagaagaaauuccagccccuuuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacucaccaaaacacaaaguucaccccagucggugucauccaggaugguggcaccacccaccgaaaugaaccccaacaaugggugcucccaaguuauucagguagaaaugucccuaauguacaccuagccccugcuguagcccccacuuuuccgggcgaacaacuucuuuucuuuagguccacuaugcccggaugcagcggguaucccaacauggauuuggacugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7306 - RNA, 1617 nt, Artificial Sequence
  VP1__Norovirus_and/or_Norovirus-like__GQ856461
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucaugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacccaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7307 - RNA, 1617 nt, Artificial Sequence
  VP1__Norovirus_and/or_Norovirus-like__AB541245
augaagauggcgucgaaugacgccaacccaucugauggguccgcagccaaccucgucccagaggucaacaaugagguuauggcuuuggagcccguugucggugccgcuauugcagcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuuaagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagagaugaccaauucaagauuccccaucccuuuggaaaaauuguucacgggucccagcagugccuuuguuguucaaccacaaaauggcagaugcacgacugauggcgugcucuuaggcaccacccaacugucuccugucaacaucugcaccuucagaggggauaucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaaugcccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7308 - RNA, 1617 nt, Artificial Sequence
  VP1__Norovirus_and/or_Norovirus-like__AB541229
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaccacuauaaucagucaaaugauucuaccauuaaauugauagcaaugcuguauacaccacuuagggcuaauaaugcuggggaggaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggagcggggcguagacguuaa

SEQ ID NO: 7309 - RNA, 1617 nt, Artificial Sequence
  VP1__Norovirus_and/or_Norovirus-like__AB541226
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacauuugcaccuucagaggggaugucacccacauugcagguucucguaauuacauaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuuacccccaugggaaauggaacggggcguagacguuaa

SEQ ID NO: 7310 - RNA, 1617 nt, Artificial Sequence
  VP1__Norovirus_and/or_Norovirus-like__DQ078814
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaacuucccaacugaagucuugagccccagccaggucacuauguucccccauauaauaguagauguuaggcaacuggaaccuguguugaucccccugccugauguuaggaauaaucucuaucauuacaaucaaucaaaugaccccaccaucagauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauuccccauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaggauccaaggcgugcucacccaaaccacaaggagggauggcucgacccgcggucacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacaggcaggguuuuguuugagugcaagcuucauaaaucaggcuauguaacaguggcucacacuggccaacaugauuugguuaucccccccaauggcuauuucagauuugauuccugggucaaccaauucuacacacuugcccccaugggaaauggagcggggcguagacguuaa

SEQ ID NO: 7311 - RNA, 1617 nt, Artificial Sequence
  VP1__Norovirus_and/or_Norovirus-like__EU078416
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuucguuguucaaccacaaaauggcaggugcacgacugauggcgugcucuuagguacuacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7312 - RNA, 1617 nt, Artificial Sequence
  VP1__Norovirus_and/or_Norovirus-like__EU839590
augaagauggcgucgaaugacgccaacccaucugguggguccgcagccaaccucgucccagaggucaacaaugagguuauggcuuuggagcccguugucggagccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcagguucucguaauuacacaaugaauuuggcuucucuaaauuggaacaauuaugacccaacagaagaaaucccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaagacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggauguagcggguaucccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaaugggacggggcguagacguuaa

SEQ ID NO: 7313 - RNA, 1617 nt, Artificial Sequence
  VP1__Norovirus_and/or_Norovirus-like__AB294783
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccauauaauaguagauguuaggcaacuggaaccuguguugaucccccugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaacucaagauucccuauuccuuuggaaaaguuguucacgggucccagcagugccuuuguuguucaaccacaaaauggcagaugcacgacugauggcgugcuuuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggggggauggcucgacccgcggucacaaagcuacaguaagcacuggaaguguccacuuuaccccaaagcugggcaguguucaauucucuacugauacaagcaaugacuuugaaacuggccaaaacacgagauucaccccagucggugucguccaggaugguaguaccacccaccaaaaugaaccccaacaaugggugcucccaaacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugaguguaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7314 - RNA, 1617 nt, Artificial Sequence
  VP1__Norovirus_and/or_Norovirus-like__AB303941
augaagauggcgucgaaugacgccaccccaucugauggguccacagccaaccucgucccagaggucaacaaugagguuauggcuuuggagcccguuguuggcgccgcgauugcggcaccuguagcgggccaacaaaauguaauugaccccuggauuagaaauaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucacuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguauccacuuuaccccaaagcugggcaguguucaauucuccacugauacaagcaaugacuuugaaacuggccaaaacacgagauucaccccagucggugucguccaggauggcaguaccacccaccaaaaugaaccccaacaaugggugcucccagacuauucagguagagauagucacaauguacaccuagccccugccguggcccccacuuuuccgggugagcaacuucuuuucuuuagguccaccaugcccggaugcagcggguaucccaacaugaauuuggauugccuacucccccaggagugggugcaacacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7315 - RNA, 1617 nt, Artificial Sequence
  VP1__Norovirus_and/or_Norovirus-like__EF126961
augaagauggcgucgaaugacgccaccccaucugauggguccacagccaaccucgucccagaggucaacaaugagguuauggcuuuggagcccguuguuggugccgccauugcggcacccguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaagaucauauuugcagcagucccaccaaauuucccaacugaaggcuugagccccagccaggucacuauguucccccauauaauaguagauguuaggcaacuggaaccuguguugauccccuugccugauguuaggaacaauuucuaucauuacaaucaaucaaaugaccccacuaucaaauugauagcaaugcuguauacaccacuuagggcuaacaaugcuggggacgaugucuucacagucucuugucgaguucucacgagaccaucccccgauuuugauuucauauuucuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucuuggaaccccagauuuuguaggaaagauccaaggcgugcucacccaaaccacgaggagggauggcucgacccguggucacaaagccacagugagcacuggaaguguccacuuuaccccaaaguugggcaguguucaauucuccacugauacaagcaaugacuuugaagcuggccaaaacacgagauucaccccagucggugucguccaggaugguagcaccacccaccaaaaugaaccccaacaaugggugcucccagauuacucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcuuacacuggccaacaugauuugguuaucccccccaauggcuauuuuagauuugauuccugggucaaccaauucuacacacuugcccccaugggaaauggagcggggcguagacguuaa

SEQ ID NO: 7316 - RNA, 1617 nt, Artificial Sequence
  VP1__Norovirus_and/or_Norovirus-like__LC153749
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuucccaacugaaggcuugagucccagccaggucacuauguucccccacauaauaguggauguuagacaguuggaaccuguguugauccccuuaccugauguuaggaauaacuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucucccgucaacaucugcaccuucagaggggaugucacccacauugcagguucucguaauuacacaaugaauuuggcuucucuaaauuggaauaauuaugauccaacagaagaaauuccagccccucuaggaacuccagauuucgugggaaagauccaagguguacucacucaaaccacaaagggagauggcucgacccguggccauaaagcuacagucuacacugggagugcccccuucacuccaaagcugggcaguguucaauucaguacugauacagaaaaugauuuugaaacucaccaagacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuagguccacuaugcccggaugcagcggguaucccaacauggauuuggacugccuacucccccaggagugggugcagcacuucuaccaagaggcagcuccagcacaaucugauguggcucuauugagauuugugaacccagacacggguaggguccuguuugagugcaaacuucacaaaucaggcuaugucacaguggcucauaccggccagcaugauuuggucaucccccccaaugguuauuuuagguuugauuccuggguuaaucaauucuacacacuugcccccaugggaaaugggacggggcguagacguuaa

SEQ ID NO: 7317 - RNA, 1617 nt, Artificial Sequence
  VP1__Norovirus_and/or_Norovirus-like__KX371610
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggggaguuuacaguauccccuagaaacgcuccaggugaaauacuauggagcgcgcccuugggcccugaucuaaaccccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuuggaacugacacagaccaugauuuugaagcuaaccaaagcacaaaguucaccccaguuggugucauccaagaugguagcaccacccaccgaaaugaaccccaacagugggugcucccaaguuacucaggcagaaauacuccuaaugugcaucuggcccccgcuguagcccccacuuucccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacguuaa

SEQ ID NO: 7318 - RNA, 1617 nt, Artificial Sequence
  VP1__Norovirus_and/or_Norovirus-like__KX354031
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccaucaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuuggaacugacacagaccaugauuucgaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcuuccccaggaaugggugcaguacuucuaccaagaggcagccccagcacaaucugauguggcucugcuaagauuugugaauccagacacugguaggguuuuauuugagugcaagcuucauaaaucaggcuauguuacaguggcucacacuggccaacaugauuugguuauuccccccaacgguuauuuuagauuugauuccugggucaaccaguucuacacgcuugcccccaugggaaauggaacggggcguagacguuaa

SEQ ID NO: 7319 - RNA, 1617 nt, Artificial Sequence
  VP1__Norovirus_and/or_Norovirus-like__KX353990
augaagauggcgucgaaugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaacaauuucuaccauuauaaucaaucaaaugaccccacuaucaaauugauagcaauguuguacacaccacuuagggcuaauaaugccggggacgaugucuucacaguuucuugucgaguucucacgagaccaucccccgauuuugacuucauauuuuuggugccacccacaguugaaucaagaacuaaaccauuuucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguaccacccaacuguccccugucaacaucugcaccuucagaggugaugucacccauauugcaggcagucgcaacuacacaaugaaucuggccucccaaaauuggaacaguuacgauccaacagaagaaaucccagccccucuagggacuccagauuucguggggaagauccaaggugugcucacccaaaccacaaggacagaugguucgacccgcggccacaaagcuacaguguacacugggagcgccgacuuuucuccaaaacuggguagaguucaauuugccacugacacagacaaugauuuugaaaccaaccaaaacacaaaguucaccccagucgguguuauacaggaugguggcaccacccaccgaaaugaaccccaacaaugggugcucccaaguuacucaggcagaaauacucauaaugugcaucuggcucccgcuguagcccccacuuucccaggcgagcagcuccucuucuucagaucuacuaugcccggaugcagcggguaccccaacauggauuuggacugucugcucccccaggaaugggugcaguauuucuaccaagaggcagccccagcacaaucugauguggcucuuuuaagguuugugaauccagacacagguaggguuuuguuugaguguaagcuccauaaaucaggcuauguuacaguggcucacacuggccaacaugauuugguuaucccccccaaugguuauuuuagauuugauucuugggucaaccaguucuacacacuugcccccaugggaaaugggacggggcgcagacguuaa

SEQ ID NO: 7320 - RNA, 1617 nt, Artificial Sequence
  VP1__Norovirus_and/or_Norovirus-like__KX353972
augaagauggcgucgaaugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagacguuaggcaauuggaaccuguguugauccccuuacccgauguuaggaacaauuucuaccauuauaaucaaucaaaugaccccacuaucaaauugauagcaauguuguacacaccacuuagggcuaauaaugccggggacgaugucuucacaguuucuugucgaguucucacgagaccaucccccgauuuugacuucauauuuuuggugccacccacaguugaaucaagaacuaaaccauuuucugucccaguuuuaacuguugaggagaugaccaauucaagguuccccauuccuuuggaaaaguuguucacgggccccaguagugccuuuguaguucaaccacaaaauggcaggugcacgacugauggcgugcuccuagguacuacccaacuguccccugucaacaucugcaccuucagaggugaugucacccauauuacaggcagucguaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacugggcagaguucaauuugccacugacacagacaaugauuuugaaaccaaccaaaacacaaaguucaccccagucgguguuauacaggaugguggcaccacccaccgaaaugaaccccaacaaugggugcucccaaguuacucaggcagaaauacucauaaugugcaucuggcccccgcuguagcccccacuuucccaggcgagcagcuccucuucuucagaucuacuaugcccggaugcagcggguaucccaacauggauuuggacugucugcucccccaggaaugggugcaguauuucuaccaagaggcagccccagcacaaucugauguggcucuuuuaagguuugugaauccagacacagguaggguuuuguuugaguguaagcuccauaaaucaggcuaugucacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7321 - RNA, 1617 nt, Artificial Sequence
  VP1__Norovirus_and/or_Norovirus-like__KX353968
augaagauggcgucgaaugacgccaacccaucugauggguccgcagccaaccucgucccagaggucaacaaugagguuauggcuuuggaacccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucacuuggccagaauguauaaugguuaugcaggugguuuugaagugcaagugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucauuauaaucagucaaaugauucuaccauuaaauugauagcaaugcuguacacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcgggcucucguaauuacacaaugaauuuggcuucucuaaauuggaacaauuaugacccaacagaagaaauuccagccccucugggaacuccagauuucgugggaaaaauccaaggugugcucacucaaaccacaaagggagauggcucgacccggggccauaaagcuacaguuuacacugggagugccgacuuuacuccaaagcugggcaguguucaauuugcuacugauacagaaaaugauuuugagacucaccaaaacacaagauucaccccagucggugucauccaggaugguggcaccacccaccgaaaugaaccccaacaaugggugcucccaagcuauucagguagaaauauccauaauguacaccuagccccugcuguagcccccaauuuuccgggugaacaacuccuuuucuucagguccacuaugccuggaugcagcggguaucccaacauggauuuggauugccuacucccccaggagugggugcaacauuucuaucaagaggcagccccagcacaaucugauguggcucuauugagauuugugaauccagacacggguaggguccuguuugagugcaaacuucauaaaucaggcuaugucacaguggcucacaccggccaacaugauuuggucaucccccccaauggcuauuuuagguuugauuccuggguuaaucaauucuauacucuugcccccaugggaaauggaacggggcguagacguuaa

SEQ ID NO: 7322 - RNA, 1617 nt, Artificial Sequence
  VP1__Norovirus_and/or_Norovirus-like__KX353967
augaagauggcgucgaaugacgccaacccaucugauggguccgcagccaaccucgucccagaggucaacaaugagguuauggcuuuggaacccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucacuuggccagaauguauaaugguuaugcaggugguuuugaagugcaagugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucauuauaaucagucaaaugauucuaccauuaaauugauagcaaugcuguacacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcgggcucucguaauuacacaaugaauuuggcuucucuaaauuggaacaauuaugacccaacagaagaaauuccagccccucugggaacuccagauuucgugggaaaaauccaaggugugcucacucaaaccacaaagggagauggcucgacccggggccauaaagcuacaguuuacacugggagugccgacuuuacuccaaagcugggcaguguucaauuugcuacugauacagaaaaugauuuugagacucaccaaaacacaagauucaccccagucggugucauccaggaugguggcaccacccaccgaaaugaaccccaacaaugggugcucccaagcuauucagguagaaauauccauaauguacaccuagccccugcuguagcccccaauuuuccgggugaacaacuccuuuucuucagguccacuaugccuggaugcagcggguaucccaacguggauuuggauugccuacucccccaggagugggugcaacauuucuaucaagaggcagccccagcacaaucugauguggcucuauugagauuugugaauccagacacggguaggguccuguuugagugcaaacuucauaaaucaggcuaugucacaguggcucacaccggccaacaugauuuggucaucccccccaauggcuauuuuagguuugauuccuggguuaaucaauucuauacucuugcccccaugggaaauggaacggggcguagacguuaa

SEQ ID NO: 7323 - RNA, 1617 nt, Artificial Sequence
  VP1__Norovirus_and/or_Norovirus-like__KX353966
augaagauggcgucgaaugacgccaacccaucugauggguccgcagccaaccucgucccagaggucaacaaugagguuauggcuuuggagcccguugucggugccgccauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucaucuggccagaauguauaaugguuaugcaggugguuuugaagugcaggugauccucgcggggaaugcguucaccgcuggaaaaauuauauuugcagcagucccaccaaauuuuccaacugaaggcuugagucccagccagaucacuauguucccccauauaauaguagauguuaggcaauuggaaccuguguugaucccccuaccugauguuaggaauaauuucuaucacuacaaucagucaaaugauuccacuauaaaauugauagcaaugcuguauacaccacuuagggccaauaaugccggggaugaugucuucacagucucuugucgaguccucacgaggccauccccugauuuugacuucauauuucuggugccaccuacaguugagucaagaaccaagccauucacugucccaauccugacuguugaagaaaugaccaauucaagauuccccauuccuuuggaaagauuguucacgggucccagcagugccuuuguuguucaaccacaaaauggcagaugcacgacugauggcgugcucuuaggcaccacccaacugucuccugucaacaucugcaccuucagaggggaugucaaccacauugcggguucucguaauuacacaaugaauuuggccucucuaaauuggaacaauuaugacccaacagaagaaaccccagccccucugggaacuccagauuucgugggaaagauccaaggcgugcucacucaaaccacaaggggaaauggcucgacccggggccauagagcuacaguuuacacugggagugccgacuucacuccaaagcugggcagaauucaauuugcuacugauacagauaaugauuuugaaacucaccaaaacacaaaauucaccccagucggugucauccaggauggcaacaccacccaccgaaaugaaccccaacaaugggugcucccaaguuauucagguagaaauguccaaaaugugcaucuagccccugcuguagcccccaauuuuccgggugaacaacuucuuuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguaggguccuauuugagugcaaacuucauaaaucaggcuuugucacaguggcucacaccggccaacaugaucuggucauccccccaaauggcuauuuuagguuugauuccuggguuaaucaauucuacacacuugcccccaugggaaagggaacggggcguagacguuaa

SEQ ID NO: 7324 - RNA, 1617 nt, Artificial Sequence
  VP1__Norovirus_and/or_Norovirus-like__AB663684
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuucccaacugaaggcuugagucccagccaggucacuauguucccccacauaauaguggauguuaggcaauuggaaccuguguugaucccccuaccugauguuaggaauaacuucuaucacuauaaucagucaaacgauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccggucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacguuaa

SEQ ID NO: 7325 - RNA, 1617 nt, Artificial Sequence
  VP1__Norovirus_and/or_Norovirus-like__KR904209
augaagauggcguccagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaacgguuaugcaggugguuuugaagugcagguaauccucgcggggaacgcguucaccgccgggaagaucauauuugcagcagucccaccaaauuucccaacugaagguuugagccccagccaggucacuauguucccccacauaauaguagauguuaggcaauuagaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagguuccccauuccuuuggaaaaguuguucacgggucccaguagugccuuuguuguucaaccacaaaacggcaggugcacgacugacggcgugcuccuagguacuacccaacugucuccugucaacaucugcaccuucagaggggaugucacccauauugcaggcagucauaacuacacaaugaaucuggcuucccaaaauuggaacaguuaugacccaacagaagaaauuccagccccucuaggaacuccagauuucguggggaagauucaaggugugcucacccaaaccacaagggcggauggcucgacccgcggccacaaagcuacaguguacacugggagcgccgacuuuucuccaaaacuggguagaguucaauuugccacugacacaaacaaugauuuugaugcuaaccaaaacacaaaguucaccccagucgguguuauccaggauggugaaacugcccaccgaaaugaaccccaacaaugggugcucccaaguuacucaggcagaaauauucauaaugugcaccuggcccccgcuguagcccccacuuuuccaggugagcagcuccucuucuucagaucuaccaugcccggaugcagcggguaccccaacauggaguuggacugucugaucccccaggaaugggugcaguauuucuaccaggaggcagccccagcacaaucugauguggcucugcuaagauuugugaauccagacacagguaggguuuuguuugaguguaagcuucauaaaucaggcuauguuacaguggcucacacuggccaacaugaucuggucaucccccccaacgguuauuuuagauuugauuccugggucaaccaguucuacacacuugcccccaugggaaacgggacggggcguagacguuaa

SEQ ID NO: 7326 - RNA, 1617 nt, Artificial Sequence
  VP1__Norovirus_and/or_Norovirus-like__AB933716
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcagguaauccucgcggggaacgcguucaccgccggaaaaauuauauuugcagcaguuccaccaaauuucccgacugaaggcuugagucccagccagguuacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggacgucacccacauugcagguucucguaauuacacaaugaauuuggcuucucuaaauuggaacaauuaugauccaacagaagaaguuccagccccucuaggaacuccagauuucgugggaaagauccaaggugugcucacucaaaccacaaagggagaugguucgacccguggccauaaagcuacagucuacacugggagugcccccuuuacuccaaagcugggcaguguucaauucaguacugauacagaaaaugauuuugaaacucaccaaaacacaaaauucaccccaguuggugucauccaggaugguagcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggauaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccaaugguuauuuuagguuugauuccuggguuaaucaauucuacacacuugcccccaugggaaauggaacggggcguagacguuaa

SEQ ID NO: 7327 - RNA, 1617 nt, Artificial Sequence
  VP1__Norovirus_and/or_Norovirus-like__AB933666
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucuuaaucccuaccuaucucauuuggccagaauguauaaugguuaugcaggugguuuugaagugcaggugauccucgcggggaacgcguucaccgccggaaaaauuauauuugcagcagucccaccaaauuucccaacugaaggcuugagucccagccaggucacuauguucccccacauaauaguggauguuagacaauuggaaccuguguugauccccuuaccugauguuaggaauaacuucuaucauuauaaucagucaaaugauucuacuauuaaauugauagcaauguuguauacaccacuuagggcuaauaaugcuggggaagaugucuuuacagucucuugucgaguucucacgaggccauccccugauuuugauuucauauuuuuggugccaccuacaguugagucuagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucucccgucaacaucugcaccuuuagaggggaugucacccacauugcagguucucguaauuacacaaugaauuuggcuucucuaaauuggaacaauuaugacccaacagaagaaauuccagccccucuaggaacuccagauuucgugggaaagauccaggguguacucacucaaaccacaaagggagauggcucgacccguggccauaaagcuacagucuacacugggagugcccccuuuacuccaaagcugggcaguguucaauucaguacugauacagaaaaugauuuugaaacucaccaagacacaaaauucaccccagucggugucauccaggaugguggcacaacccaccgaaaugaaccccaacaaugggugcucccaagcuauucugguagaaaugucccuaauguacaccuagccccugcuguagcccccacuuucccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaacccagacacggguaggguccuguuugagugcaaacuccacaaaucaggcuaugucacaguggcucauaccggccagcaugauuuggucaucccccccaaugguuauuuuagguuugauuccuggguuaaucaauucuacacacuugcccccaugggaaaugggacggggcguagacguuaa

SEQ ID NO: 7328 - RNA, 1617 nt, Artificial Sequence
  VP1__Norovirus_and/or_Norovirus-like__EU921349
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccacuaucaaauugauagcaauguuguauacaccacuuagggcuaauaaugcuggggacgaugucuucacaguuuccugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccagauuauucagguagagauagucacaaugugcaccuagccccugccguggcccccucuuuuccgggugagcaacuucuuuucuucagguccacuaugcccggaugcaguggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7329 - RNA, 1617 nt, Artificial Sequence
  VP1__Norovirus_and/or_Norovirus-like__EU921348
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuugugcaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaagugucaauuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccagauuauucagguagagacagucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7330 - RNA, 1617 nt, Artificial Sequence
  VP1__Norovirus_and/or_Norovirus-like__EU921345
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaauggcaggugcacgacugauggcgugcuccuagguacuacccaacugucuccugucaacaucugcaccuucagaggggaugucacccacauugcaggcacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccagauuauucagguagagauggucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7331 - RNA, 1617 nt, Artificial Sequence
  VP1__Norovirus_and/or_Norovirus-like__KP698924
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugauguuuucacaguuucuugccguguucucacgagaccaucccccgauuuugacuucauauuucuagugccacccacaguugagucaagaacuaaaccauucucugucccaguuuuaacuguugaggagaugaccaauucaagguuccccauuccuuuggaaaaguuguucacgggucccagcagugccuuugucguccaaccacaaaacggcaggugcacgacugauggcgugcuccuaggcaccacccaacugucuccugucaacaucugcaccuucagaggagaugucacccauaucacagguagucauaacuacacaaugaauuuggcuucucaaaauuggagcaauuacgacccaacagaagaaaucccagccccucuaggaauuccagacuuuguggggaagauucaaggcgugcuuacccaaaccacaaggacagauggcucaacacgcggccacaaagccacaguguacacugggagcgccgacuuugcuccaaaacuggguagaguucaauuugaaacugacacaaaccaugacuuugaagccaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcagcacuucuaccaagaggcagccccagcacaaucugauguggcucugcuaagauuugugaauccagacacaggcaggguuuuguuugaauguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7332 - RNA, 1617 nt, Artificial Sequence
  VP1__Norovirus_and/or_Norovirus-like__LC005707
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggucccgaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggcgccuuuguuguucaaccgcaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaacuaugacccaacagaagaaauuccagccccucuaggaaccccagauuucgugggaaagauccaaggugugcucacucaaaccacaaaggcagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaucaagaggcagcuccagcacaaucugauguggcucuauugagauuugugaauccagaccaggggaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7333 - RNA, 1617 nt, Artificial Sequence
  VP1__Norovirus_and/or_Norovirus-like__KJ541743
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaaugcuccaggugaaauacuauggagcgcgcccuuaggcccugaucugaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauucccuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaucaaaacacaaaauucaccccagucggugucauccaggaugguggcaccacccaccgaaaugaaccccaacaaugggugcucccaaguuauucagguagaaauguccauaauguacaccuagccccugcuguggcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugacguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcgcagacguuaa

SEQ ID NO: 7334 - RNA, 1617 nt, Artificial Sequence
  VP1__Norovirus_and/or_Norovirus-like__KF177443
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccacuauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaacuaugacccaacagaagaaaucccagccccucuagggacuccagauuuuguggggaaaauucaaggugugcucacccaaaccacaagaacagauggcucaacacguggccacaaagcuacaguguacaccgggagcgccgauuuugcuccaaaacuggguagaguucaauuuggaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccagcaugauuugguuaucccccccaaugguuauuuuagguuugauuccugggucaaccaguuuuacacgcuugcccccaugggaaauggaacggggcguagacguuaa

SEQ ID NO: 7335 - RNA, 1617 nt, Artificial Sequence
  VP1__Norovirus_and/or_Norovirus-like__JX439842
augaagauggcgucgagugacgccaacccaucugauggguccgcagccaaccucgucccagaggucaacaaugagguuauggcuuuggaacccguugucggugccgcuauugcggcgccuguagcgggccaacaaaauguaauugaccccuggauuagaaauaauuuuguacaagccccugguggggaguuuacaguguccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaacaacuucuaucauuauaaucagucaaaugauucuaccauuaaauugauagcaaugcuguauacgccgcuuagggcuaauaacgcuggggaagaugucuuuacagucucuugucgaguucucacgaggccauccccugauuuugauuuuauauuuuuagugccaccuacagucgagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguguuuacacaaugaauuuggccucucuaaauuggaacaauuaugacccaacagaagaaauuccagccccucuaggaacuccagauuuugugggaaagauccaaggugugcucacucaaaccacaaaggaagacggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugccccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaacccagacacggguaggguccuguuugagugcaaacuucauaaaucaggcuaugucacaguggcucacaccggucagcaugauuuggucaucccccccaaugguuauuuuagguuugauuccuggguuaaucaauuuuacacacuugcccccaugggaaauggaacggggcguagacguuaa

SEQ ID NO: 7336 - RNA, 1617 nt, Artificial Sequence
  VP1__Norovirus_and/or_Norovirus-like__HF952135
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguaucccccagaaacgcuccaggugaaauacuauggagcgcacccuuaggcccugauuugaaccccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagucaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucuccugucaacaucugcaccuucagaggggaugucacccacauuucaggcagucguaacuacacaaugaauuuggcugcccaaaauuggaacaguuacgauccaacagaagaaaucccagccccucuaggaacuccagauuucguggggaagauucaaggugugcucacccaaaccacaaagacaaauggcucgacccgcggccacaaagcuacaguguacacugggagcgccgacuuuucuccgaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacccauaauguacaccuggcccccgcuguagcccccacuuucccgggcgagcagcuccucuucuucaggucuacuaugcccggaugcagcggguaccccaacauggaucuggacugucugcucccccaggagugggugcaguauuucuaucaggaggcagccccagcacaaucugacguggcucuguuaagauuugugaauccagauacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7337 - RNA, 1617 nt, Artificial Sequence
  VP1__Norovirus_and/or_Norovirus-like__JX459598
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggcacgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugaugucaggaacaauuuuuaucauuacaaucaaucaaaugaccccaccaucaaauugauagcaaugcuguauacaccacucagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucagccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguauccacuucaccccaaagcugggcaguguucaauucuccacugauacaagcaaugacuuugaaacuggccaaaacacgagauucaccccagucgguguuguccaggaugguaguaccacccaccaaaaugaaccccaacaaugggugcucccaaacuauucagguagagauagucacaauguacaccuagccccugccguggcccccacuuucccgggugagcaacuucuuuucuuuagguccacuaugcccggaugcagcggguaucccaacaugaauuuggauugccuacucccccaggagugggugcaacacuucuaccaagagucagccccagcacaaucugauguggcacugcugagauuugugaauccagacacugguaggguauuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7338 - RNA, 1617 nt, Artificial Sequence
  VP1__Norovirus_and/or_Norovirus-like__JX445162
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaggugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaauguuguauacaccacuuagggcuaauaaugcuggggaagaugucuucacagucucuugccgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuauucacgggucccagcagcgccuuuguuguucaaccacaaaauggcagaugcacgacugauggcgugcucuuaggcaccacccaacugucuccugucaacaucugcaccuucagaggggaugucacccacauugcagguucucguaauuacacgaugaauuuggcuucucuaaauuggaacaauuaugacccaacagaagaaauuccagccccucuaggaacuccagauuucgugggaaagauccaaggcgugcucacccaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcauuucuaccaagaggcagcuccagcacaaucugauguggcucuauugagauucguaaauccagacacggguaggguccuguuugagugcaagcuucauaaaucaggcuaugucacaguggcucacaccggccagcaugauuugauuaucccccccaaugguuauuuuagguuugauuccuggguuaaucaauucuacacacuugcccccaugggaaauggaacggggcguagacguuaa

SEQ ID NO: 7339 - RNA, 1617 nt, Artificial Sequence
  VP1__Norovirus_and/or_Norovirus-like__JX445154
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaauaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagguucccuauuccuuuggaaaaguuguucacgggucccagcagugccuuuguuguucaaccacaaaauggcagaugcacgacugauggcgugcuuuuaggcaccacccaacugucuccugucaacaucugcaccuucagaggggaugucacccacauugcagguacucaaaauuacacaaugaaucuggccucccagaauuggaacaauuaugacccaacagaagagaucccagcuccucugggaaccccagauuuuguaggaaagauccaaggcgugcucacccaaaccacaaggagggacggcucgacccgcggucacaaagccacaguaagcacuggaaguguccacuucaccccaaagcugggcagcguucaauucucuacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaccaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7340 - RNA, 1617 nt, Artificial Sequence
  VP1__Norovirus_and/or_Norovirus-like__JX155752
augaagauggcgucgaaugacgccaacccaucugauggguccgcagccaaccucgucccagaggucaacaaugagguaauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugauuugaaucccuaccuaucucauuuggccaggauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaguuggaaccuguguugaucccccuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggccccagcagugccuuuguuguucaaccacaaaauggcagaugcacgacugauggugugcucuuaggcaccacccaacugucuccugucaauaucugcaccuucagaggggaugucacccacauugcagguucucacaauuacgcaaugaauuuggccucucuaaauuggaacaauuaugacccaacagaagagauuccagccccucuaggaacuccagauuuuguaggaaagauccaaggugugcucacucaaaccacaaagggagaugguucgacccguggccauaaagcuacaauuuacacugggagugcccccuuuacuccaaagcugggcaguguucaauucaguacugauacagaaaaugauuuugaaacucaccaaaacacaaaauucaccccagucgguguuauccaggauggugguaccacccaccgaaaugaaccccaacaaugggugcucccaaguuauucagguagaaaugucccuaauguacaccuagccccugcuguagccccuacuuucccgggugaacaacuccuuuucuuuaggucuacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaucucacgguggcucacaccggccagcaugauuuggucaucccccccaaugguuauuuuagguuugauuccuggguuaaucaauucuacacacuugcccccaugggaaauggaacggggcguagacguuaa

SEQ ID NO: 7341 - RNA, 1617 nt, Artificial Sequence
  VP1__Norovirus_and/or_Norovirus-like__HM748971
augaagauggcgucgaaugacgccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacagugucccccagaaacgcuccaggugaaauauuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaacgcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacuacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggcgcucccaaguuauucagguagaaauguccagaauguacaccuagccccugcuguagcccccacuuuuccgggugaacaacuucuuuucuuuagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugaguguaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacguuaa

SEQ ID NO: 7342 - RNA, 1617 nt, Artificial Sequence
  VP1__Norovirus_and/or_Norovirus-like__GQ845367
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauaugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaacuaaaccauucucugucccaauuuuaacuguugaggagaugaccaauucaagguuccccauuccuuuggaaaagcuguucacgggccccaguagugccuuuguuguucaaccacaaaacggcaggugcacgacugauggcgugcuccuagguacuacccaacugucuccugucaacaucugcaccuucagaggggaugucacccauauugcaggcagucguaacuacacaaugaaucuggcuucccagaauuggaauaguuaugacccaacagaagaaaucccagccccucuaggaacuccagauuucguggggaagauucaaggugugcucacccaaaccacaaggacggauggcucgacccgcggccacaaagcuacaguguacacugggagcgccgacuuuucuccaaaacuggguagaguucaauuugccacugacacagacaaugauuuugaugcuaaccaaaacacaaaguucaccccagucgguguuauccaggaugguaauacugcccaccgaaaugaaccccagcaaugggugcucccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacucgcccccaugggaaaugggacggggcguagacguuaa

SEQ ID NO: 7343 - RNA, 1617 nt, Artificial Sequence
  VP1__Norovirus_and/or_Norovirus-like__GQ856455
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaaucauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagccaaaugauucuaccauuaaauugauagcaaugcuguauacaccacuuagggcuaauaaugcuggggaagaugucuucacagucucuugucgaguucucacgaggccauccccugauuuugauuuuauauuucuggugccaccuacaguugagucaagaacuaaaccauuuacugucccaaucuuaacuguugaagaaaugaccaauucaagauuccccauuccuuuggaaaaauuguucacgggucccagcagugccuuuguuguccaaccacaaaauggcagaugcacgacugauggcgugcucuuaggcaccacccaacugucuccugucaacaucugcaccuucagaggggaugucacucacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggggauggcucgacccauggccauaaagcuacaguuuacacugggagugcccccuucacuccaaagcuggguaguguucaauucagcacugauacagaaaaugauuuugaaacucaccaaaacacaaaauucaccccagucggugucauccaggaugguagcaccacccaccgaaaugaaccccaacaaugggugcucccaaguuauucagguagaaauguccaaaauguacaccuagccccugcuguggcccccacuuuuccgggugaacaacuucuuuucuuuagguccacuaugcccggaugcagcggguaucccaacauggauuuggauugccuacucccccaggagugggugcagcauuucuaccaagaggcagcuccagcacaaucugauguggcccuauugagauucgugaauccagacacggguaggguccuguuugagugcaaacuucauaaaucaggcuaugucacaguggcucacaccggccagcaugauuugguuaucccccccaaugguuauuuuagguuugauuccuggguuaaucaauucuacacacuugcccccaugggaaauggaacggggcguagacguuaa

SEQ ID NO: 7344 - RNA, 1617 nt, Artificial Sequence
  VP1__Norovirus_and/or_Norovirus-like__GQ856447
augaagauggcgucgaaugacgccaacccaucugauggguccgcagccaaccucgucccagaggucaacaaugagguuauggcuuuggagcccguugucggagccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccaaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagagcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcagguucucguaauuacacaaugaauuuggcuucucuaaauuggaacaauuaugauccaacagaagaaaucccagccccucuaggaacuccagauuuugugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggauguagcggguaucccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaaugggacggggcguagacguuaa

SEQ ID NO: 7345 - RNA, 1617 nt, Artificial Sequence
  VP1__Norovirus_and/or_Norovirus-like__AB541318
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuucguacaagccccugguggagaguucacaguauccccuagaaacgcuccaggugaaauacuguggagcgcgcccuuagguccugauuugaaucccuaccuuucccauuuggccagaauguacaaugguuaugcaggugguuuugaagugcaggugauccucgcggggaacgcguucaccgccggaaagaucauauuugcagcagucccaccaaauuucccaacugaagguuugagccccagccaggucacuauguucccccacauaauaguagauguuaggcaauuggaaccuguguugaucccccuacccgauguuaggaauaauuucuaucacuacaaccaaucaaaugaccccaccaucaaauugauagcaauguuguauacaccacuuagggccaauaaugcuggggacgaugucuucacaguuucuugucggguucucacgagaccaucccccgauuuugauuucauauuuuuaguaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggccacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugcuacugacacagacaaugauuuugaugcuaaccaaaacacaaaguucaccccagucggugucauccaggaugguaauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuauuccccccaaugguuauuuuagauuugauuccugggucaaccaguucuacacacuugcccccaugggaaauggaacggggcguagacguuaa

SEQ ID NO: 7346 - RNA, 1617 nt, Artificial Sequence
  VP1__Norovirus_and/or_Norovirus-like__AB541307
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauuuuugcagcagucccaccaaauuuuccaacugaaggcuugagucccagccaggucacuauguucccccacauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguagcccccacuuuuccgggugaacagcuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuccauaaaccaggcuaugucacaguggcucacaccggccagcaugauuugguuauccccuccaauggcuauuuuagguuugauuccuggguuaaucaauucuacacacuugcccccaugggaaauggaacggggcguagacguuaa

SEQ ID NO: 7347 - RNA, 1617 nt, Artificial Sequence
  VP1__Norovirus_and/or_Norovirus-like__AB541254
augaagauggcgucgaaugacgccaacccaucugauggguccgcagccaaccucgucccagaggucaacaaugaggucauggcuuuggagcccguugucggugccgcuauugcggcgccuguagcgggccaacaaaauguaauugaccccuggauuagaaauaauuuugugaaagccccugguggagaguucacaguauccccuagaaacucuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugacucuaccauuaaauugauagcaaugcuguauacaccacuuagggccaauaaugcuggggaugaugucuucacagucuccugucgaguccucacgaggccauccccugauuuugacuuuauauuuuuggugccaccuacaguugagucaagaacuaagccauuuacugucccaaucuuaacuguugaggaaaugaccaauucaagauuccccauuccuuuggaaaaauuguucacgggucccagcagugccuuuauuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaguuccagccccucugggaacuccagauuucgugggaaagauccaaggugugcucacucaaaccacaaagggagauggcucgacccggggccauaaagcuacaguuuacacugggagugccgacuuuacuccaaaguugggcaguguucaauuuggcacugauacagaaaacgauuuugaaacucaccaaaacacaaaauucaccccagucggugucauccaggaugguagcaccacccaccgaaaugaaccccaacaaugggugcucccaaguuauucaggcagaaauguccauaauguacaccuagccccugcuguagcccccaauuucccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccugacacggguaggguccuguuugagugcaaacuacauaaaucaggcuaugucacaguggcucacaccggucaacaugauuuggucaucccccccaauggcuacuuuagguuugacuccuggguuaaucaauucuacacacuugcccccaugggaaauggaacggggcguagacguuaa

SEQ ID NO: 7348 - RNA, 1617 nt, Artificial Sequence
  VP1__Norovirus_and/or_Norovirus-like__AB541243
augaagauggcgucgaaugacgccaacccaucugauggguccgcagccaaccucgucccagaggucaacaaugagguuauggcucuggagcccguugucggugccgcuauugcggcaccuguagcgggccaacaaaauguaauugaccccuggauuagaaauaauuuuguucaagccccugguggagaguucacaguaucuccuagaaacgcuccaggugaaauaccauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcacuuucagaggggaugucacccacauugcaggcucucgugauuacacaaugaauuuggcuucucuaaauuggaacaauuacgacccaacagaagaaauuccagccccucuaggaacuccagauuucgugggaaagauucaaggugugcucacucaaaccacaaagggggauggcucgacccguggccauaaagcuacaguuuacacugggagugcccccuuuacuccaaagcugggcaguguucgauucaguacugauacagaaaaugauuuugaaacucaccaaaacacaaaauucaccccagucggugucauccaggacgguaguaccacccaccgaaaugaaccccaacaaugggugcucccaaguuauucagguagagauguccauaauguacaccuagccccugcuguagcccccacuuuuccgggugagcaacuucuuuucuucagguccacuaugcccggaugcaguggguaucccaacauggauuuggacugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuucagguuugacuccuggguuaaucaauucuacacacuugcccccaugggaaauggaacggggcguagacguuaa

SEQ ID NO: 7349 - RNA, 1617 nt, Artificial Sequence
  VP1__Norovirus_and/or_Norovirus-like__AB541232
augaagauggcgucgaaugacgccaacccaucugauggguccgcagccaaccucgucccagaggucaacaaugagguuauggcuuuggagcccguugucggugcugcuauugcggcgccuguagcgggccaacaaaauguaauugaccccuggauuagaaauaauuuuguacaagcccccgguggagaguucacaguauccccuaggaacgcuccaggugaaauacuauggagcgcgccccuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggagcccguguugauccccuuaccugauguuaggaauaacuucuaucauuauaaucagucaaaugacucuaccauuaaauugauagcaaugcuguauacaccacuuagggcuaauaaugcuggggaagaugucuucacagucucuugucgaguccucacgaggccguccccugauuuugauuuuauauuuuuggugccaccuacaguugagucaagaacuaaaccauuuacugucccaaucuuaacuguugaagaaaugaccaauucaagauucccuauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggaguacccccuuuacuccaaagcugggcaguguucaauucagcacugauacagaaaaugauuuugaaacucaccaaaacacaaaauuuaccccagucggugucauccaggaugguagcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguauccuaacauggauuuggauugccuacucccccaggagugggugcagcacuucuaccaagaggcagcuccagcacaaucugauguggcucuacugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7350 - RNA, 1617 nt, Artificial Sequence
  VP1__Norovirus_and/or_Norovirus-like__GQ246800
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguuuacaguguccccuagaaaugcuccaggugagauauuauggagugcgcccuugggcccugauuugaacccuuaccuuucucaucuggccagaauguauaaugguuaugcaggugguuuugaagugcagguaauccucgcggggaacgcguucaccgccggaaaaaucauauuugcagcaguuccaccuaacuuuccaacugaaggcuugagccccagccagguuacuauguucccccauauaauaguagauguuaggcaauuggaaccuguguugauccccuuaccugauguuaggaauaauuucuaucauuauaaucaaucaaaugacccuaccauuaaauugauagcaaugcuguacacaccacuuagggcuaauaaugcuggggaugaugucuucacagucucuugccgaguccucacgagaccauccccugauuuugauuucauauuuccgguaccaccaacaguugaaucaagaaccaaaccauuuaccguuccgaucuuaacuguugaggaaaugaccaauucaagauuccccauuccuuuggaaagauuguacacgggucccagcagugccuuuguuguccagccacaaaacggcaggugcacgacugauggcgugcucuuaggcaccacccagcugucugcugucaacaucugcaccuuuagaggggaugucacucacauugcaggcucucgcaauuauacaaugaauuuggccucucaaaauuggaacaacuaugauccaacagaagaaaucccagccccccugggcaccccagacuucgugggaaagauccaaggcaugcucacccaaaccacaagaagugauggcucgacucgcggccacaaggccacagugcucacugggagugccgacuucgccccaaaauugggcagaguccaauucgccacugacacagacaacgauuucgaaucuggccaaaacaccaaauucaccccaguuggcgucauccaggaugguuccacuacccaccgaaaugaaccucaacaauggguacucccaaauuacucagguagaacuggucacaaugugcaucuagccccugcuguugcccccacuuacccgggugagcaacuccuuuucuucagguccacuaugcccggauguagcggguaccccaacauggaucuagauugcuugcucccccaggagugggugcagcacuucuaccaagaagcagcuccagcacaaucugauguggcucugcuaagauuugugaauccagacacagguaggguucucuuugagugcaagcuccauaaaucaggauaugucacaguggcucacacuggucagcaugauuugguuauuccccccaaugguuauuuuagauuugauuccuggguuaaucaguucuacacacuugcccccaugggaaauggaacggggcguagacguuaa

SEQ ID NO: 7351 - RNA, 1617 nt, Artificial Sequence
  VP1__Norovirus_and/or_Norovirus-like__GU390900
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccuaauuuuccaaccgaaggcuugagucccagccaggucacuauguucccccacauaauaguggauguuaggcaauuggaaccuguguugauucccuuaccugauguuaggaauaacuucuaucacuauaaucagucaagugauucuaccauuaaauugauagcaaugcuguacacaccacuuagggcuaauaaugcuggggaagacgucuuuacagucucuugccgaguucucacgaggccauccccugauuuugauuuuauauucuuggugccaccuaccguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggagaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagaugguucgacccguggccacaaagcuacaguuuacacugggagugcccccuucacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccaaaaugugcaccuagccccugcuguagcccccacuuuuccgggugaacaacuucuuuucuuuagguccacuaugcccggaugcagcggguaucccaacauggauuuggauugccuacucccccaggagugggugcaacacuucuaucaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7352 - RNA, 1617 nt, Artificial Sequence
  VP1__Norovirus_and/or_Norovirus-like__AB504328
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaagucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuugacuucucuaaauuggaacaauuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguauaaauguucauaauguacaccuagccccugcuguagcccccacuuuuccgggugaacaacuucuuuucuucagguccacuaugcccgggugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaauggcuauuuuagguuugauuccuggguuaaucaauucuacacacuugcccccaugggaaauggaacggggcgcagacguuaa

SEQ ID NO: 7353 - RNA, 1617 nt, Artificial Sequence
  VP1__Norovirus_and/or_Norovirus-like__AB447434
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugaccccaccaucaaauugauagcaauguuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccaguggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacccaccaaaacacaaaauucaccccagucggugucauccaggaugguagcaccacccaccgaaaugaaccccaacaaugggugcucccaaguuacucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7354 - RNA, 1617 nt, Artificial Sequence
  VP1__Norovirus_and/or_Norovirus-like__EU839591
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggcgguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugccgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccgaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccaccuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugaaugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7355 - RNA, 1617 nt, Artificial Sequence
  VP1__Norovirus_and/or_Norovirus-like__AB291542
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaacgggcaugcaggugguuuugaagugcaggugauccucgcggggaacgcguucaccgccggaaaaauuauauuugcagcagucccaccaaauuucccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucugaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccugggucaaucaauucuacacacuugcccccaugggaaauggaacggggcgcaggcguuaa

SEQ ID NO: 7356 - RNA, 1617 nt, Artificial Sequence
  VP1__Norovirus_and/or_Norovirus-like__KX354123
augaagauggcgucgagugacgccaacccaucugaugggucugcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguucacaguguccccuaggaacgcuccaggugaaauacuauggagcgcgcccuugggaccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaauuagaaccuguguugauucccuuacccgauguuaggaauaauuucuaucauuauaaucaaucaaaugaccccaccauuaaguugauagcaauguuguauacuccacucagggcuaauaaugcuggggaugaugucuucacaguuucuugccgaguucucacgagaccaucccccgacuuugauuucauauuucuagugccacccacagucgagucaagaacuaaaccauucucugucccagucuuaacuguugaggagaugaccaauucaagauuccccauuccuuuggaaaggcuguucacgggucccagcagugccuuugucguccaaccacaaaacggcaggugcacgacugauggcgugcuccuaggcaccacccaacugucuccugucaacaucugcaccuucagaggagaugucacccacaucacagguagucauaacuacacaaugaauuuggcuucucaaaauuggaacaauuaugacccaacagaagaaaucccagccccccuaggaacuccagacuuuguggggaagauucaaggcgugcucacccaaaccacaaggacagauggcucaacacgcggccacaaagccacauuguacacugggagcgccgaauuugcuccaaaacuggguagaguucaauuugagacugacacaaaccaugauuuugaagcuaaccaaaacacaaaauucaccccagucggugucauccaagaugguagcaccacccaccgaaaugaaccccaacagugggugcucccaacuuacucaggcagaaauacucauaaugugcaucuggcccccgcuguagcccccaccuucccgggugagcaacuucucuucuucagauccaccaugcccggauguagcggguaccccaacauggauuuggacugucugcucccccaggaaugggugcagcacuucuaccaagaggcagccccagcacaaucugauguggcucugcuaagauuugugaauccagacacagguaggguuuuguuugaguguaagcuucauaaaucaggcuauauuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7357 - RNA, 1617 nt, Artificial Sequence
  VP1__Norovirus_and/or_Norovirus-like__KX354050
augaagauggcgucgagugacgccaacccaucugauggguccgcagccaaccucgucccagaggucaacaaugagguuauggcucuggagcccguuguuggugccgccauugcggcaccuguagcgggccaacaaaauguuauugaccccuggauuagaaacaauuuuguacaagccccugguggagaguuuacaguaucccccagaaacgcuccaggugaaauacuauggagcgcgcccuuaggcccugaucuaaaucccuaccuaucccauuuggccagaauguacaaugguuaugcagguggucuugaagugcagguaauucuugcggggaacgcguucaccgccgggaagaucauauuugcagcagucccaccaaauuucccaacugaaggcuugagccccagccaggucacuauguucccccauauaauaguagauguuaggcaacuagaaccuguguugauucccuuacccgauguuaggaauaauuucuaucauuacaaucaaucaaaugaucccaccauuaaguugauagcaauguuguauacaccacuuagggcuaauaaugcuggggacgaugucuucacaguuucuugccgaguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagcuccucuaggaacuccagauuuuguggggaagauucaaggugugcucacccaaaccacaagggcagauggcucgacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacaguggguacucccaaguuacucaggcagaaauacucauaaugugcaucuggcccccgcuguagcccccacuuuuccgggugagcaacuccucuucuucagauccacuaugcccggaugcagcggguaccccaacauggauuuggacugucugcuuccccaggaaugggugcaauacuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagguuugacuccuggguuaaucaguucuacacgcuugcccccaugggaaauggaacggggcguagacguuaa

SEQ ID NO: 7358 - RNA, 1617 nt, Artificial Sequence
  VP1__Norovirus_and/or_Norovirus-like__AB933717
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaauggcuaugcaggugguuuugaagugcagguaauccucgcggggaacgcguucaccgccggaaaaauuauauuugcagcagucccaccaaauuucccgacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuugacuguugaggaaaugaccaauucaagguuccccauuccuuuggaaaaguuguucacgggucccaguagugccuuuguuguucaaccacaaaauggcagaugcacgacugauggcgugcucuuaggcaccacccaacugucuccugucaacaucugcaccuucaggggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuaccaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuauguuacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7359 - RNA, 1617 nt, Artificial Sequence
  VP1__Norovirus_and/or_Norovirus-like__AB933707
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagucaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccgggugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7360 - RNA, 1617 nt, Artificial Sequence
  VP1__Norovirus_and/or_Norovirus-like__AB933705
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaacccuauggagcgcgcccuuaggcccugaucugaaucccuaccuaucucacuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacacuggccagcaugauuuggucaucccccccaaugguuauuuuagguuugauuccuggguuaaucaauucuacacacuugcccccaugggaaauggaacggggcguagacguuaa

SEQ ID NO: 7361 - RNA, 1617 nt, Artificial Sequence
  VP1__Norovirus_and/or_Norovirus-like__AB933704
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucacuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagguuccccauuccuuuggaaaaauuguucacggguccuagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacagucuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuuguaaauccagacacggguaggguccuguuugagugcaaacuucauaaaucaggcuaugucacaguggcucacaccggccaguaugauuuggucaucccccccaaugguuauuuuagguuugauuccugggucaaucaauuuuacacacuugcccccaugggaaauggaacggggcguagacguuaa

SEQ ID NO: 7362 - RNA, 1617 nt, Artificial Sequence
  VP1__Norovirus_and/or_Norovirus-like__AB933699
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccgggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucauuacaaucaguuaaaugauucuaccauuaaauugauagcaauguuguauacgccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaguuuggcuucucuaaauuggaacaauuaugacccaacagaagaaauuccagccccucuaggaaccccagauuucgugggaaagauucaaggagugcucacucaaaccacaaagggagauggcucgacccgcggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaucuagccccugcuguagcccccacuuuuccgggugaacaacuucuuuucuucagguccacuaugcccggaugcagcggguaccccaacauggauuuggauugccugcucccccaggagugggugcagcacuucuaccaagaggcagcuccagcacaaucugauguggcucuauugagauuugugaauccagacacggguaggguccuguuugagugcaagcuucacaagucaggcuaugucacaguggcucacaccggccagcaugauuuggucaucccccccaaugguuauuuuagguuugauuccuggguuaaucaguucuacacacuugcccccaugggaaauggaacggggcguagacguuaa

SEQ ID NO: 7363 - RNA, 1617 nt, Artificial Sequence
  VP1__Norovirus_and/or_Norovirus-like__AB933679
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuucuggugccaccuacaguugagucaagaacuaaaccauuuacugucccaaucuuaacuguugaagaaaugaccaacucaagauuccccauuccuuuggagaaguuguucacgggucccagcagugccuuuauuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacgcuugcccccaugggaaauggaacggggcguagacguuaa

SEQ ID NO: 7364 - RNA, 1617 nt, Artificial Sequence
  VP1__Norovirus_and/or_Norovirus-like__AB933661
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgagcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacaggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagcccccgcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugacuccuggguuaaucaauucuacacgcuugcccccaugggaaauggaacggggcguagacguuaa

SEQ ID NO: 7365 - RNA, 1617 nt, Artificial Sequence
  VP1__Norovirus_and/or_Norovirus-like__KT152148
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuguggagcgcgcccuuaggcccugaucugaaucccuaccuaucucauuuggccagaauguauaaugguuaugcaggugguuuugaagugcaagugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugccgaguccucacgaggccauccccugauuuugauuucauauuuuuggugccaccuacaguugagucaagaacuaaaccauuuacugucccaaucuuaacuguugaagagaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacucacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuuguaaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7366 - RNA, 1617 nt, Artificial Sequence
  VP1__Norovirus_and/or_Norovirus-like__EU921393
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauucucgcggggaacgcguucaccgccggaaaaauuauauuugcagcagucccaccaaauuuuccaacugaaggucugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucauaauuacacaaugaauuuagcaucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguaguaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7367 - RNA, 1617 nt, Artificial Sequence
  VP1__Norovirus_and/or_Norovirus-like__KM396961
augaagauggcgucgagugacgccaacccaucugauggguccgcagccaaccucgucccagaggucaacaaugagguuauggcucuggagcccguuguuggugccgccauugcggcacccguagcgggccaacaaaauguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuugcccgauguuaggaauaauuucuaucauuacaaucaaucaaaugaccccaccauuaaguugauagcaauguuguacacaccacuuagggcuaacaaugcuggggaugaugucuucacaguuucuugccgaguucucacgagaccauccccugauuuugauuucauauuuuuaguaccacccacaguugagucaagaacuaaaccauucucugucccaguuuuaacuguugaggagaugaccaauucuagauuccccaucccuuuggaaaaguuguucacgggccccagcagugccuuuguuguccaaccacaaaacgguaggugcacgacugauggcgugcuccuaggcaccacccaacugucuccugucaacaucugcaccuucagaggagaugucacccauaccacagguagucauaacuacacuaugaauuuggcuucucaaaauuggagcaauuaugacccaacagaagaaaucccagccccucuagggacuccagauuuuguggggaagauucaaggcgugcucacccaaaccacaaggacagauggcucaacacgcggccacaaggccacagugcgcacugggagcgccgacuuugcuccaaaacuggguagaguucaauuugaaacugacacagaccaugacuuugaagcuaaccaaaacacaaaguucaccccaguuggugucauccaagaugguagcaccacccaccgaaaugaaccccaacagugggugcucccaaguuacucaggcagaaauacuccuaauguacaucuggccccugcuguagcccccacuuuuccgggugagcaacuucucuucuucagauccaccaugcccggaugcagcggguaccccaacauggauuuggacugucugcucccccaggaaugggugcagcacuucuaccaagaggcagccccagcacaaucugauguggcucugcuaagauucgugaauccagacacagguaggguuuuguuugaguguaagcuucauaaaucaggcuauguuacaguggcucacacuggccaacaugauuugguuaucccccccaaugguuauuuuagguuugacuccugggucaaccaguuuuacacgcuugcccccaugggaaauggaacggggcguagacguuaa

SEQ ID NO: 7368 - RNA, 1617 nt, Artificial Sequence
  VP1__Norovirus_and/or_Norovirus-like__KM198485
augaagauggcgucgaaugacgccaacccaucugauggguccgcagccaaccucgucccagaggucaacaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuuuccaacugaaggccugagucccagccaggucacuauguucccccacauaauaguagauguuaggcaauuggaaccuguguugauccccuuaccugauguuaggaauaacuucuaucacuauaaccagacaaaugauucuaccauuaaacugauagcaaugcuguauacaccacuuagggccaauaaugcuggggaagaugucuucacagucucuugucgaguccucacgaggccauccccugauuuugauuuuauauuuuuggugccacccacaguugagucaagaacuaaaccauuuacugucccaaucuuaaccguugaagaaaugaccaauucaagauuccccauuccuuuggaaaaacuguucacgggucccagcagcgccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcaucucuaaacuggaacaauuaugacccaacagaagaaauuccagccccucuaggaacuccagauuucgugggaaagauccaaggugugcucacucaaaccacaaaaggagauggcucgacccguggccauaaagccacaguuuacacugggagugcccccuucacuccaaagcugggcaguguucaauucagcaccgacacagaaaaugauuuugaaacucaccaaaacacaaaauucaccccagucggcgucauccaggaugguggcaccacccaccgaaaugaaccccaacaaugggugcucccaaguuauucagguagaaauguccauaauguacaccuagccccugcuguagcccccacuuuuccgggugaacaacuucucuucuucagguccacuaugcccggaugcagcggguaucccaacauggauuuggauugccuacucccccaggagugggugcagcacuucuaccaagaggcagcuccagcacaaucugauguggcucuauuaagauuuguaaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaacggaacggggcguagacgcuaa

SEQ ID NO: 7369 - RNA, 1617 nt, Artificial Sequence
  VP1__Norovirus_and/or_Norovirus-like__KF306214
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccacauaguaguagauguuaggcaacuagaaccuguguugauucccuuacccgauguuaggaauaauuuuuaucacuacaaucaaucaaaugaccccaccauuaaguugauagcaauguuguacacaccacuuagggccaauaaugcuggggaugaugucuucacaguuucuugccgaguucucacgagaccaucccccgacuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggagcuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacagaccaugauuuugaaguuaaccaaaacacaaaguucaccccaguuggugucauccaagaugguggcaccacccaccgaaaugaaccccaacagugggugcucccaaguuacucaggcaggaauacuccuaaugugcaucuggcccccgcuguagcccccacuuuuccgggugagcaacuucucuucuucagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacaauggccaacaugauuugguuaucccccccaaugguuauuuuagguuugauuccugggucaaccaguuuuacacgcuugcccccaugggaaauggaacggggcguagacguuaa

SEQ ID NO: 7370 - RNA, 1617 nt, Artificial Sequence
  VP1__Norovirus_and/or_Norovirus-like__JX439831
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuaggaacgcuccaggugaaauacuguggagcgcgccccuaggcccugauuugaauccuuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuuuacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgauugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuugcuccaaaacuggguagaguucaauuugccacugacacagacaaugauuuugaugcuaaccaaaacacaaaguucaccccagucggugucauccaggaugguaauacugcccaccgaaaugaaccccaacaaugggugcucccaaguuacucagguagaaauagucacaaugugcaccuggcccccgcuguagcccccacuuuuccgggugagcaauuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuucagauuugauuccugggucaaccaguucuacacacuugcccccaugggaaauggaacggggcguagacguuaa

SEQ ID NO: 7371 - RNA, 1617 nt, Artificial Sequence
  VP1__Norovirus_and/or_Norovirus-like__KC409281
augaagauggcgucgaaugacgccaacccaucugauggguccgcagccagccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagacaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccacaaagcuacaguuuacacugggagugcccccuuuacuccaaagcugggcaguguucaauucaguacugacacagaaaaugauuuugaaacucaccaaaacacaaaauucaccccaguugguguuauccaggaugguggcaccacccaccgaaaugaaccccaacaaugggugcucccaagcuauucagguagagauguucauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcgcaaucugauguggcucuauuaagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7372 - RNA, 1617 nt, Artificial Sequence
  VP1__Norovirus_and/or_Norovirus-like__JX459639
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagcuccugguggagaguucacaguauccccuagaaacgcuccaggugaaauacuauggagcgcgcccuuaggcccugaucugaaccccuaccuaucccauuuggccagaauguauaaugguuaugcaggugguuuugaagugcaagugauccucgcggggaacgcguucaccgccgggaaaaucauauuugcagcagucccaccaaauuuuccaacugagggcuugagccccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaggauguuuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggcaugcucacucaaaccacaaagggagaugguucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguagcaccacccaccggaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7373 - RNA, 1617 nt, Artificial Sequence
  VP1__Norovirus_and/or_Norovirus-like__JX459609
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuugcuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagagaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugccacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7374 - RNA, 1617 nt, Artificial Sequence
  VP1__Norovirus_and/or_Norovirus-like__JN400599
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaacaauuuuguacaagccccugguggagaguuuacaguauccccuagaaacgcuccaggugaaauauuauggagcgcacccuugggcccugauuugaaucccuaccucucccacuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaacuggaaccuguguugaucccccugccugauguuaggaauaauuuuuaucauuacaaccaaucaaaugaccccaccaucaaauugauagcaaugcuguauacaccacucagggcuaacaaugcuggggacgaugucuucacagucucuugucgaguucucacgagaccauccccugauuuugauuucauauuucuggugccacccacaguugagucaagaacuaaaccauucucugucccaaucuuaacuguugaggagaugaccaauucaagauucccuauuccucuggaaaaguuguucacgggucccagcagugccuuuguuguucagccacaaaauggcagaugcacgacugauggcgugcucuuagguacuacccaauugucuccugucaacaucugcaccuucagaggggaugucacccacauugcagguacucaaaauuacacaaugaaucuggccucucaaaauuggaacaauuaugacccaacagaagaaaucccagccccucugggaaccccagauuuuguaggaaagauccaaggcgugcucacccaaaccacaaguagggauggcucgacccgcggucacaaagccacagugagcacuggaaguguccacuucaccccaaagcugggcaguguccaguucuccacugauacaagcaaugauuuugaaacuggccaaaacacgagauucaccccagucgguguuguccaggaugguaguaccacccaccaaaaugaaccccaacaaugggugcucccaaacuauucagguagagauagucacaauguacaccuagccccugccguggcccccacuuucccgggugagcaacuccuuuucuuuagguccacuaugcccgggugcagcggguaucccaacaugaauuuggauugccuacucccccaggagugggugcaacacuucuaccaagagucagcuccagcacaaucugauguggcacuguugagauuugugaauccagacacagguagggucuuguuugagugcaagcuucauaaaccaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7375 - RNA, 1617 nt, Artificial Sequence
  VP1__Norovirus_and/or_Norovirus-like__JQ613539
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaauaacuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccggaaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacucagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguaguaccuuuguuguucaaccacaaaacggcaggugcacgacugauggcgugcuccuagguacuacccaacugucuccagucaacaucugcaccuucagaggggaugucacccauauugcaggcagucauaacuacacaaugaaucuggcuucccaaaauuggaacaguuaugacccaacagaagaaaucccagccccucuaggaacuccagauuucguggggaagauucaaggugugcucacccaaaccacaaggacggauggcucgacccgcggccacaaagcuacaguguacacugggagcgccgaauuuuccccaaaacuggguagaguucaauuugccacugacacaaacaaugacuuugaugcuaaccaaaacacaaaguucaccccagucgguguuauccaggauggugguacuacccaccgaaaugaaccccaacaaugggugcuuccaaguuacucaggcagaaauacucauaaugugcaccuggcccccgcuguagcccccacuuuuccgggugaacagcuccucuucuucagaucuaccaugcccggaugcagcggguaccccaacauggauuuggacugucugaucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7376 - RNA, 1617 nt, Artificial Sequence
  VP1__Norovirus_and/or_Norovirus-like__HQ456329
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauauuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcaacacuucuaccaagaggcagcuccagcacaaucugacguggcucuauugagguuugugaacccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7377 - RNA, 1617 nt, Artificial Sequence
  VP1__Norovirus_and/or_Norovirus-like__HM802536
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggagcuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7378 - RNA, 1617 nt, Artificial Sequence
  VP1__Norovirus_and/or_Norovirus-like__HM802532
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggcgguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaguuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccaugggaaauggaacggggcguagacguuaa

SEQ ID NO: 7379 - RNA, 1617 nt, Artificial Sequence
  VP1__Norovirus_and/or_Norovirus-like__AB541341
augaagauggcgucgaaugacgccaacccaucugauggguccgcagccaaccucgucccagaggucaacaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaggaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguaugcucacucaaaccacaaagggagacgguucgacccguggucauaaagcuacaguuuacacugggagugcccccuuuacuccaaagcugggcaguguucaauucaguacugauacagaaaaugauuuugaaacucaccaaaacacaaaauucaccccagucggugucauccaggaugguaacaccacccaccggaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7380 - RNA, 1617 nt, Artificial Sequence
  VP1__Norovirus_and/or_Norovirus-like__AB541264
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuucuaucacuauaaucagucaaaugacucuaccauuaaauugauagcaaugcuguauacaccacuuagggcuaauaacgcuggggaagaugucuuuacagucucuugucgaguucucacgaggccauccccugauuuugauuuuauauuucuggugccaccuacagucgagucaagaacuaaaccauuuacugucccagucuuaacuguugaagaaaugaccaacucaagauuccccauuccuuuggaaaaauuguucacgggucccagcagugccuuuguuguucaaccacaaaauggcagaugcacgacugauggcgugcucuuagguaccacccaacugucuccugucaacaucugcaccuucagaggggaugucacccacauugcagguucucgugauuacacaaugaauuuggcuucucuaaacuggaacaauuaugacccaacagaagaaauuccagccccucuaggaacuccagauuucgugggaaagauccaaggugugcucacucaaaccacaaggggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguggcccccacuuuuccgggugaacaacuucuuuucuuuagguccacuaugcccggaugcaguggguaucccaacauggauuuggauugccuacucccccaggagugggugcagcauuucuaccaagaggcagcuccagcacaaucugauguggcucuauugagauuugugaacccagacacgggaaggguccuguuugagugcaaacuucauaaaucaggcuaugucacaguggcucacaccggccagcaugauuugguuauuccccccaaugguuauuuuagguuugauuccuggguuaaucaauucuacacacuugcucccaugggaaauggaacggggcguagacguuaa

SEQ ID NO: 7381 - RNA, 1617 nt, Artificial Sequence
  VP1__Norovirus_and/or_Norovirus-like__AB541236
augaagauggcgucgaaugacgccaacccaucugauggguccgcagccaaccucguccaggaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccucacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacauuugcaccuucagaggggaugucacccacauugcagguucucguaauuacauaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguggaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7382 - RNA, 1617 nt, Artificial Sequence
  VP1__Norovirus_and/or_Norovirus-like__AB541208
augaagauggcgucgaaugaccccagcccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguguccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacugucucuugucgaguucucacgaggccauccccugauuuugauuuuauauuuuuggugccaccuacaguugagucaagaacuaaaccauuuacugucccaaucuuaacuguugaagaaaugaccaacucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggccucucuaaauuggaacaauuaugacccaacagaagaaauuccagccccucuaggaacuccagauuucgugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagagauguccagaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacguuaa

SEQ ID NO: 7383 - RNA, 1617 nt, Artificial Sequence
  VP1__Norovirus_and/or_Norovirus-like__EU876890
augaagauggcgucgaaugacgcuaccccaucugauggguccacagccaaccucgucccagaggucaacaaugagguuauggcuuuggagcccguugugggugccgcuauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucauuacaaucaaucaaaugaccccacuaucaaauugauagcaaugcuguauacaccacuuagggcuaacaaugcuggggacgaugucuucacagucucuugucgaguucucacgagaccaucccccgauuuugauuucauauuucuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccguggucacaaagccacagugagcacuggaaguguccacuuuaccccaaaguugggcaguguucaauucuccacugauacaagcaaugacuuugaaacuggccaaaacacgagauucaccccagucggugucguccaggaugguaguaccacccaccaaaaugaaccccaacaaugggugcucccagauuauucagguagagauagucacaauguacaccuagccccugccguggcccccaauuucccgggugagcaacuucuuuucuuuagguccacuaugcccggaugcagcggguaucccaacaugaauuuggauugccuacucccccaggagugggugcaacacuucuaccaagagucagccccagcacaaucugauguggcacugcugagauuugugaauccagacacagguaggguuuuguuugagugcaagcuucauaaaucaggcuacguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7384 - RNA, 1617 nt, Artificial Sequence
  VP1__Norovirus_and/or_Norovirus-like__AB385638
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaaugaccccaccaucaaauugauagcaauguuguauacaccacuuagggcuaauaaugcuggggaugaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcuaauacccaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucucuacugauacaagcaaugauuuugaaacuggccaaaacacgagauucaccccagucgguguuguccaggaugguaguaccacccaccaaaaugaaccccaacaauggguacucccaaauuauucagguggagauggccacaaugugcaccuagccccugccguggcccccucuuuuccgggugagcaacuucucuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7385 - RNA, 1617 nt, Artificial Sequence
  VP1__Norovirus_and/or_Norovirus-like__AB385635
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauucgcagcagucccaccaaacuucccaacugaaggcuugagccccagccaggucacuauguucccccauauaauaguagauguuaggcaacuggaaccuguguugauccccuugccugauguuaggaauaauuucuaucauuacaaucagucaaaugaccccaccaucaaauugauagcaaugcuguauacaccacuuagggcuaacaaugcuggggacgaugucuucacagauucuugucgaguucucacgagaccaucccccgauuuugauuucauauuuuuggugccacccacaguugagucaaggacuaaaccauuuucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguaccacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucuccacugauacaagcaaugaccuugaaaccggccaaaacacgagauucaccccagucggugucguccaggaugguaguaccacucaccaaaaugaaccccaacaaugggugcucccagacuauucagguagagacagucacaauguacaccuagccccugccguggcucccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcgcugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7386 - RNA, 1617 nt, Artificial Sequence
  VP1__Norovirus_and/or_Norovirus-like__EU366113
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauccaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuucccggugaacaacuucuuuucuuuagguccacugugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuauguuacaguggcucacaccggccagcaugauuuggucaucccccccaaugguuauuuuagguuugauuccuggguuaaucaauucuacacacuugcccccaugggaaaugggacggggcguagacguuaa

SEQ ID NO: 7387 - RNA, 1617 nt, Artificial Sequence
  VP1__Norovirus_and/or_Norovirus-like__KX354097
augaagauggcgucgagugacgccaacccaucugauggguccgcagccaaccucgucccagaggucaacaaugagguuauggcucuggaacccguuguuggugccgccauugcggcaccuguagcgggccaacaaaauguaauugaccccuggauuagaaauaauuuuguacaagccccugguggagaauuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaucccaccauuaaguugauagcaauguuguauacaccacuuagggcuaauaaugcuggggaugaugucuucacaguuucuugccgaguucucaccagaccaucccccgauuuugauuucauauucuuagugccacccacaguugagucaagaacuaaaccauucucugucccaguuuuaacuguugaggagaugaccaauucaagauuccccauuccuuuggaaaagcuguucacgggucccagcagugccuuuguuguccaaccacaaaacggcaggugcacgacugauggcgugcuccuaggcaccacccaauugucuccugucaacaucugcaccuucagaggagaugucacccacaucacagguagucauaacuacacaaugaauuuggcuucucaaaauuggaacaauuacgacccaacagaagaaaucccagccccucuaggaacuccagacuuuguggggaagauucagggcgugcucacccagaccacaaagacagauggcucaacacgcggccacaaagccacaguguacacugggagcgccgacuuugcuccaaaacuggguagaguucaauuugaaacugacacaaaccaugauuuugaagcuaaccaaaacacaaaguucaccccagucggugucauccaagaugguagcaccacccaucgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagauacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7388 - RNA, 1617 nt, Artificial Sequence
  VP1__Norovirus_and/or_Norovirus-like__AB933727
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacgguauccccuagaaacgcuccaggugaaauacuauggagcgcacccuuaggcccugaucugaaucccuaccuaucucauuuggccagaauguauaaugguuaugcaggugguuuugaagugcagguaauccucgcggggaacgcguucaccgccggaaaaauuauauuugcagcagucccaccaaauuucccgacugaaggcuugagucccagccaggucacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccacccacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggacgucacccacauugcagguucucguaauuacacaaugaauuuggcuucucuaaauuggaacaauuaugauccaacagaagaaguuccagccccucuaggaacuccagauuucgugggaaagauccaaggugugcucacucaaaccacaaagggagaugguucgacccguggccauaaagcuacagucuacacugggagugcccccuuuacuccaaagcugggcaguguucaauucaguacugauacagaaaaugauuuugaaacucaccaaaacacaaaauucaccccaguuggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggauaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcccacaccggccagcaugauuuggucaucccccccaaugguuauuuuagguuugauuccuggguuaaucaauucuacacacuugcccccaugggaaauggaacggggcguagacguuaa

SEQ ID NO: 7389 - RNA, 1617 nt, Artificial Sequence
  VP1__Norovirus_and/or_Norovirus-like__AB933726
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7390 - RNA, 1617 nt, Artificial Sequence
  VP1__Norovirus_and/or_Norovirus-like__AB933720
augaagauggcgucuagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuuuuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagguccagggugugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7391 - RNA, 1617 nt, Artificial Sequence
  VP1__Norovirus_and/or_Norovirus-like__AB933691
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuaucucauuuggccagaauguauaaugguuacgcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauucacugucccaaucuuaacuguugaggaaaugaccaauucaagauuccccauuccuuuggaaaaguuguucacggguccuagcagugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaacuggaacaauuaugacccaacagaagaaauuccagccccucuaggaacuccggauuucgugggaaagauccaagguaugcucacucaaaccacaaaaggagaugguucgacccguggccauaaagccacaguuuacacugggagugcccccuuuacuccaaagcugggcaguguucaauucaguacugauacagaaaaugauuuugaaacccaccaaaacacaaaauucaccccagucggugucauccaggaugguagcaccacccaccgaaaugaaccccaacaaugggugcucccaaguuauucagguagagaugucccuaauguacaccuagccccugcuguagcucccacuuucccgggugaacaacuccuuuucuuuaggucuacuaugcccggaugcagcggguaucccaacauggauuuggauugccuacucccccaggaguggguucagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7392 - RNA, 1617 nt, Artificial Sequence
  VP1__Norovirus_and/or_Norovirus-like__AB933682
augaagauggcgucuaacgacgccaacccaucugauggguccacagccaaccucgucccagaggucaacaaugagguuauggcuuuggagcccguaguuggugccgcuauugcggcaccuguagcgggccaacagaaugugauugaccccuggauuagaaauaauuuuguacaagccccugguggagaguucacaguauccccuagaaaugcuccaggugaaauacuauggagcgcgcccuuaggcccugaucugaaucccuaccuuucccauuuggccagaauguauaaugguuaugcaggugguuuugaagugcaggugauccucgcggggaacgcguucaccgccggaaaaauuauauuugcagcagucccaccaaacuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaggaugucuucacagucucuugucgaguccucacgagaccauccccugauuuugauuuuauauuuuuggugccaccuacaguugagucaagaacuaaaccauuuacugucccaaucuuaacuguugaagaaaugaccaauucaagauuccccauuccuuuggaaaaauuguuuacgggucccagcagugccuuuguuguucaaccacaaaauggcagaugcacgacugauggcgugcucuuaggcaccacacaacugucuccugucaacaucugcaccuucagaggggaugucacccacauugcagguucucauaauuacacaaugaauuuggccucucuaaauuggaacaauuaugacccaacagaagaaauuccagccccucuaggaaccccagauuucgugggaaagauccaaggugugcucacucaaaccacaaagggagaugguucgacccguggccauaaagcuacaguuuacacugggagugcccccuuuacuccaaagcuaggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacguuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7393 - RNA, 1617 nt, Artificial Sequence
  VP1__Norovirus_and/or_Norovirus-like__KM245069
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguauaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaacgaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagcgccuuuguuguucaaccacaaaauggcaggugcacgacugauggcgugcucuuagguacuacccaacugucuccugucaacaucugcaccuucagaggggaugucacccacauugcuaguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugacguggcucugcuaagauuugugaauccagacacagguaggguuuuguuugaguguaagcuucauaaaucaggcuaugucacaguggcucacacuggccaacaugauuuaguuaucccccccaauggcuauuuuagauuugauuccugggucaaccaguucuacacacuugcccccaugggaaaugggacggggcguagacguuaa

SEQ ID NO: 7394 - RNA, 1617 nt, Artificial Sequence
  VP1__Norovirus_and/or_Norovirus-like__LC005717
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuaaaaauaauuuuguacaagccccugguggagaguucacaguauccccuagaaacgcaccaggcgagauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaauuucuaccauuauaaucagucaaaugauucuaccauuaaauugauagcaauguuguauacaccacuuagagcuaauaaugcuggggaagaugucuucacagucucuugucgaguccucacgaggccaucccccgauuuugauuuuauauuuuuggugccaccuacaguugagucaagaacuaaaccauuuacugucccgaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaaccccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuccauaaaucagguuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7395 - RNA, 1617 nt, Artificial Sequence
  VP1__Norovirus_and/or_Norovirus-like__LC005705
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugacuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaauuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuacucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7396 - RNA, 1617 nt, Artificial Sequence
  VP1__Norovirus_and/or_Norovirus-like__KC894943
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucaaucaaaugauucuaccauuaaguugauagcaaugcuguauacaccacuuagggcuaauaaugcuggggaagaugucuucacagucucuugucgaguccucacgaggccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagcuccucuaggaacuccagauuucgugggaaagauccaaggugugcucacucaaaccacuaagggggaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaauuauucagguagugaugucccuaauguacaccuagccccugcuguagcccccaauuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugaauguaaacuccauaaaucaggcuaugucacaguggcucacaccggccagcaugauuuggucaucccccccaaugguuauuuuagguuugauuccuggguuaaucaauucuacacacuugcccccaugggaaauggaacggggcgcagacguuaa

SEQ ID NO: 7397 - RNA, 1617 nt, Artificial Sequence
  VP1__Norovirus_and/or_Norovirus-like__KF060023
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauauuguggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuuggaacugacacagaccaugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7398 - RNA, 1617 nt, Artificial Sequence
  VP1__Norovirus_and/or_Norovirus-like__KC409310
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagacaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccacaaagcuacaguuuacacugggagugcccccuuuacuccaaagcugggcaguguucaauucaguacugacacagaaaaugauuuugaaacucaccaaaacacaaaauucaccccagucgguguuauccaggaugguggcaccacccaccgaaaugaaccccaacaaugggugcucccaagcuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7399 - RNA, 1617 nt, Artificial Sequence
  VP1__Norovirus_and/or_Norovirus-like__JX989073
augaagauggcgucgaaugacgccaacccaucugauggguccgcagccaaccucgucccagaggucaacaaugagguuauggcuuuggagcccguugucggcgccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaauuuuccaacugaaggcuugagccccagccaggucacuauguucccccacauaauaguggauguuaggcaauuggaaccuguguugauccccuuaccugauguuaggaauaacuucuaucacuauaaccaaucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaaccaaaccauuuacugucccaaucuuaacuguugaggaaaugaccaauucaagauuccccauuccuuuggaaaaguuguucacgggucccagcagugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguaugcucacucaaaccacgaaaggagaugguucgacccguggccauaaagcuacaguuuauacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaagcuauucagguagagauaucccuaauguacaccuagccccugcuguagcccccacuuucccgggugaacaacuucuuuucuuuaggucuacuaugcccggaugcagcggguaucccaacauggauuuggauugccugcucccccaggagugggugcagcacuucuaccaagaggcagcuccagcacaaucugauguggcucuauugagguuugugaauccagacacgggcaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7400 - RNA, 1617 nt, Artificial Sequence
  VP1__Norovirus_and/or_Norovirus-like__JX459902
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcacccuuaggcccugauuugaauccuuaccuuucccauuuggccagaauguacaaugguuaugcaggugguuuugaagugcagguaauccucgcggggaacgcguucaccgccgggaaaaucauauuugcagcagucccaccaaguuucccaauugaagguuugagccccagucaggucacuauguucccccacauaauaguagauguuaggcaauuggagccuguguugauucccuuacccgauguuaggaauaauuucuaccauuauaaucaaucaaaugaccccaccaucaaauugauagcaauguuguauacaccacuuagggcuaauaaugccggggacgaugucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggagaaguuguucacgggccccaguagugccuuuguuguucaaccacaaaacggcagaugcacgacugauggcgugcuccuagguacuacccaacugucuccugucaacaucugcaccuucagagggaaugucacccacauuucaggcagucguaacuacacaaugaauuuggcuucccaaaauuggaacaguuacgacccaacagaagaaaucccagccccucuaggaacuccagauuucguggggaagauucaaggugugcucacccaaaccacaaagacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacccauaauguacaccuggcccccgcuguagcccccacuuucccgggcgagcagcuccucuucuuuagaucuacuaugcccggaugcagcggguaccccaacauggaucuggacugucugcucccccaggagugggugcaguauuucuaucaggaggcagccccagcacaaucugacguggcucuguuaagauuugugaauccagauacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7401 - RNA, 1617 nt, Artificial Sequence
  VP1__Norovirus_and/or_Norovirus-like__JX459644
augaagauggcgucgaaugacgccaacccaucugauggguccgcagccaaccucgucccagaggucaacaaugagguuauggcuuuggagcccguuguuggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccaucccccgauuuugauuuuauauuuuuggugccaccuacaguugagucaagaacuaaaccauuuacugucccaaucuuaacuguugaagaaaugacuaauucgagauuccccauuccuuuggaaaaguuguucacgggucccagcggugccuuuguuguucaaccacaaaauggcaggugcacgaccgauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaacuccagauuucguggggaagauccaaggugugcucacccaaaccacaaagggagauggcucgacccguggccauaaagcuacaguuuacacugggagugccgacuucacuccaaagcugggcaguguucaauucagcacugauacagaaaaugauuuugaaacucaccaaaacacaaaguucaccccagucggugucauccaggaugguagcaccacccaucgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaccccaacaugaauuuggauugccuaaucccccaggagugggugcagcacuucuaccaagaagcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauuuuacacacuugcccccaugggaaauggagcggggcguagacguuaa

SEQ ID NO: 7402 - RNA, 1617 nt, Artificial Sequence
  VP1__Norovirus_and/or_Norovirus-like__JX459610
augaagauggcgucgaaugacgcccacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaacuacacaaugaauuuggcuucucuaaauuggaccaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7403 - RNA, 1617 nt, Artificial Sequence
  VP1__Norovirus_and/or_Norovirus-like__JX459606
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggcgaaauacuauggcgcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccgaauuuuccaacugaaggcuugagucccagccaggucacuauguucccccacauaauaguggauguuaggcaauuggaaccuguguugauccccuuaccugauguuaggaauaacuuuuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaguuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucacuccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaacgguuauuuuagguuugauuccugggucaaucaauucuacacacuugcccccaugggaaauggaacggggcguagacguuaa

SEQ ID NO: 7404 - RNA, 1617 nt, Artificial Sequence
  VP1__Norovirus_and/or_Norovirus-like__JX445159
augaagauggcgucgaaugacgccaacccauccgauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagugcgcccuuaggcccugauuugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuacuauuaaauugauagcaaugcuguauacaccacuuagggcuaauaaugcuggggaagaugucuucacagucucuugucggguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucguggggaagauccaaggugugcucacucaaaccacagagggagauggcucgacccguggccauaaagcuacaguuuacacugggagugccccuuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7405 - RNA, 1617 nt, Artificial Sequence
  VP1__Norovirus_and/or_Norovirus-like__JN400606
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaauuuuuaucacuauaaucagucaaaugauucuaccauuaaauugauagcaauguuguauacaccacuuagggcuaauaaugcuggggaagaugucuucacagucucuugucgaguucucacgaggccauccccugauuuugauuuuauauuuuuggugccaccuacaguugagucaagaacuaaaccauucacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7406 - RNA, 1617 nt, Artificial Sequence
  VP1__Norovirus_and/or_Norovirus-like__JQ613562
augaagauggcgucgaaugacgccaacccaucugauggguccgcagccaaccucgucccagaggucaacaaugagguuauggcuuuggagccuguuguuggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauucuacuauuaaauugauagcaaugcuguauacaccacuuagggccaauaaugccggggaugaugucuucacagucucuugucgaguccucacgaggccauccccugauuuugacuucauauuuuuggugccacccacaguugagucaagaacuaagucauuuacugucccaaucuugacuguugaagaaaugacuaauucaagauuccccauuccuuuggaaaaauuguucacgggucccagcagugccuuuguuguucaaccacaaaacgguagaugcacgacugauggcgugcucuuaggcaccacccaacugucuccugucaacaucugcaccuucagaggggaugucacccacauugcugguucucgcaauuacacaaugaauuuggccucucuaaauuggaacaacuaugauccaacagaagaaauuccagccccucuggggacuccagauuucguggggaagauccaaggugugcucacucaaaccacaaagggagauggcucgacccggggccauaaagcuacaguuuacacugggagugccgacuucacuccaaagcuggguaguguucaauuugguacugauacggacaaugauuuugaaacucaccaaaacacaaaauucaccccagucggugucauccaggaugguagcaccacccaccguaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggacuuggauugccuacucccccaggagugggugcagcacuucuaccaagaggcagcuccagcacaaucugauguggcuuuauugagauuugugaauccagacacggguaggguccuguuugaaugcaaacuucauaaaucaggcuaugucacaguggcucacacuggucaacaugaucuggucaucccccccaaugguuauuuuagguuugauuccuggguuaaucaguucuacacacuugcccccaugggaaauggagcggggcguaaacguuaa

SEQ ID NO: 7407 - RNA, 1617 nt, Artificial Sequence
  VP1__Norovirus_and/or_Norovirus-like__HQ456343
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucauuauaaucagucaaaugauuccaccauuaaguugauagcaaugcuguauacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucucuaaauuggaacaauuaugacccaacagaagaaauuccagccccucugggaacuccagauuucgugggaaagauccaaggugugcucacucaaaccacaaagggggauggcucgacccggggccauaaagcuacagucuacacugggagugccgacuuuacuccaaagcugggcaguguucaauuugcuacugauacagaaaaugauuuugaaacucaccaaaacacaaaauucaccccagucggugucauccaggaugguagcaccacccaccgaaaugaaccccaacaaugggugcccccaaguuauucagguagaaauguccauaauguacaccuagccccugcuguagcccccaauuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguagggucuuguuugagugcaaacuucauaaaucaggcuaugucacaguggcucacaccggccaacaugauuuggucaucccccccaaugguuauuuuagguuugauuccuggguuaaucaauucuauacacuugccccuaugggaaauggaacggggcguagacgauaa

SEQ ID NO: 7408 - RNA, 1617 nt, Artificial Sequence
  VP1__Norovirus_and/or_Norovirus-like__HQ456342
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggagacgaugucuucacaguuucuugucggguucucacgagaccaucccccgacuuugauuucauauuuuuaguaccacccacaguugagucaagaacuaaaccauucucugucccaauuuuaacuguugaggagaugaccaauucaagguuccccauuccuuuggaaaagcuguucacgggucccagcagugccuuuguuguucaaccacaaaacggcaggugcacgacugauggcgugcuccuaggcaccacucaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccauaaagcuacaguguacacugggagcgccgauuuugcuccaaaacuggguagaguucaauuugccacugacacagacaaugauuuugaugcuaaccaaaacacaaaguucaccccagucggugucauccaggauggugguacugcccaccgaaaugaaccccaacaaugggugcucccaaguuacucaggcagaaauagucauaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7409 - RNA, 1617 nt, Artificial Sequence
  VP1__Norovirus_and/or_Norovirus-like__HQ456340
augaagauggcgucgaaugacgccagcccaucugauggguccgcagccaaccucgucccagaggucaacaaugagguuauggcuuuggagcccguugucggugccgcaauugcggcgccuguagcgggccaacaaaauguaauugaccccuggauuagaaauaauuuuguacaagccccugguggagaguucacaguauccccuagaaacgcuccaggcgaaauauuguggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagcuccagccagguuaccauguucccccacauaauaguagauguuaggcaauuggaaccuguguugauccccuuaccugauguuaggaauaacuucuaucauuauaaucagucaagugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggcgccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucugaauuggaacaauuaugacccaacagaagaaauuccagccccucuaggaaccccagauuucgugggaaagauccaaggugugcucacucaaaccacaaaggcagauggcucgacccguggccauaaagcuacaguuuauacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccgaguuauucagguagaaauguccauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7410 - RNA, 1617 nt, Artificial Sequence
  VP1__Norovirus_and/or_Norovirus-like__HQ456326
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaguaguagauguuaggcaauuggaaccuguguugauccccuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuacgacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7411 - RNA, 1617 nt, Artificial Sequence
  VP1__Norovirus_and/or_Norovirus-like__HM802527
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauuucagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucacccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7412 - RNA, 1617 nt, Artificial Sequence
  VP1__Norovirus_and/or_Norovirus-like__GQ856448
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuugugcaagccccugguggagaguucacaguauccccuagaaacgcuccaggugaaauacuauggagcgcgcccuuaggcccugaucugaaucccuaucuaucucauuuggccagaauguauaaugguuaugcagguggcuuugaagugcaggugauucucgcggggaacgcguucaccgccggaaaaauuauauucgcagcagucccaccaaauuuuccaacugaaggcuugagccccagccaggucacuauguucccccauauaauaguagauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuucacaguuucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccucuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggcgucauccaggaugguagcaccacccaccgaaaugaaccccaacaaugggugcucccaaguuauucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugacuccuggguuaaucaauucuacacacuugcccccaugggaaauggaacggggcgcagacguuaa

SEQ ID NO: 7413 - RNA, 1617 nt, Artificial Sequence
  VP1__Norovirus_and/or_Norovirus-like__AB541347
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugcuuuuguuguucaaccacaaaauggcagaugcacgacugauggcgugcucuuaggcaccacccaacugucuccugucaacaucugcaccuucagaggggaugucacccacauugcagguucucgugauuacacaaugaauuuggcuucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggaguguccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7414 - RNA, 1617 nt, Artificial Sequence
  VP1__Norovirus_and/or_Norovirus-like__AB541298
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagacgucuucacagucucuugucgaguccucacgaggccguccccugauuuugauuuuauauuuuugacaccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugacuuggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacguuaa

SEQ ID NO: 7415 - RNA, 1617 nt, Artificial Sequence
  VP1__Norovirus_and/or_Norovirus-like__AB541270
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaacaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccgcggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuccuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaagucaggcuaugucacaguggcucacaccggccaguaugauuuggucaucccccccaauggcuauuuuagguuugauuccuggguuaaucaauucuacacacuugcccccaugggaaauggaacggggcguagacguuaa

SEQ ID NO: 7416 - RNA, 1617 nt, Artificial Sequence
  VP1__Norovirus_and/or_Norovirus-like__AB541263
augaagauggcgucgaaugacgccaacccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaauugauagcaaugcuguauacaccacuuagggcuaauaaugcuggggaagaugucuuuacagucucuugucgaguucucacgaggccauccccugauuuugauuuuauauucuuggugccaccuacaguugagucaagaacuaaaccguuuacugucccaaucuuaacuguugaagaaaugaccaauucaagguucccuauuccuuuggaaaaauuguucacgggucccagcagugccuuuguuguucaaccacaaaauggcagaugcacgacugauggcgugcucuuaggcaccacccaacugucuccugucaacgucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagagaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagccccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7417 - RNA, 1617 nt, Artificial Sequence
  VP1__Norovirus_and/or_Norovirus-like__AB541256
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuaccauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucgagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccagcaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuaaucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccaugggaaauggagcggggcguagacguuaa

SEQ ID NO: 7418 - RNA, 1617 nt, Artificial Sequence
  VP1__Norovirus_and/or_Norovirus-like__AB541240
augaagauggcgucgaaugacgccaacccaucugauggguccgcagccaaccucgucccagaggucaacaaugagguuauggcuuuggagcccguugucggugccgcuauugcggcgccuguagcgggucaacaaaauguaauugaccccuggauuagaaauaauuuuguacaagcccccgguggagaguucacaguguccccuagaaacgcucccagugaaauacuauggagcgcgcccuuaggcccugaccugaaccccuaccuaucucauuuggccagaauguauaaugguuaugcaggugguuuugaagugcaggugauccucgcggggaacgcguucaccgccggaaaaaucauauuugcagcagucccaccaaauuuuccaacugaaggcuugagucccagccaggucacuauguucccccacauaauaguggauguuaggcaauuggagccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucuauaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccaaaaugaaccccaacaaugggugcucccagguuauucagguagaaaugucccuaauguacacuuagccccugcuguagcucccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacguuaa

SEQ ID NO: 7419 - RNA, 1617 nt, Artificial Sequence
  VP1__Norovirus_and/or_Norovirus-like__AB541233
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauauuauggagcgcgcccuuaggcccugaccugaaucccuaccuaucucauuuggccagaauguacaaugguuaugcaggugguuuugaagugcaggugauccucgcggggaacgcguucaccgccgggaaaauuauauuugcagcagucccaccaaauuuuccaacugaaggcuugagccccagccaggucacuauguucccccacauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuucacagucucuugucgaguucucacgagaccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcacuuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacccaaaccacaaagggagauggcucgacccguggccacaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaagcaggcuaugucacaguggcucacaccggccagcacgauuuggucaucccccccaaugguuacuuuagguuugauuccuggguuaaucaauucuacacacuugcccccaugggaaauggaacggggcguagacguuaa

SEQ ID NO: 7420 - RNA, 1617 nt, Artificial Sequence
  VP1__Norovirus_and/or_Norovirus-like__AB541215
augaagauggcgucgaaugacgccaacccaucugauggguccgcggccaaccucgucccagaggucaacaaugagguuauggcuuuggagcccguugucggugccgcuauugcggcgccuguagcgggccaacaaaauguaauugaccccuggauuagaaauaacuuuguacaagccccugguggagaguucacaguauccccuagaaacgcuccaggugaaauaccauggagcgaacccuuaggcccugaucugaaucccuacuuaucucauuuggccagaauguauaaugguuaugcaggugguuuugaagugcaggugauccucgcggggaacgcguucaccgccggaaagauuauauuugcagcagucccaccaaauuuuccaacugaaggcuugagucccagccaggucacuauguucccccacauaauaguagauguuaggcaauuggaaccuguguugauccccuugccugauguuaggaauaacuucuaccacuauaaucagucaaaugauucuaccauuaaauugauagcaaugcuguauacaccacuuagggccaauaaugcuggggaagaugucuucacggucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaaugugcaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccaacaugaucuggucaucccccccaauggcuauuuuagguuugauuccuggguuaaucaauucuacacacuugcccccaugggaaauggaacggggcguagacguuaa

SEQ ID NO: 7421 - RNA, 1617 nt, Artificial Sequence
  VP1__Norovirus_and/or_Norovirus-like__AB541201
augaagauggcgucgaaugacgccaacccaucugauggguccgcagccaaccucgucccagaggucaacaaugagguuauggcuuuggagcccguugucggugccgccauugcggcgccuguagcgggccaacaaaauguaauugaccccuggauuagaaauaauuuuguacaagccccugguggggaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagaugucaggcaauuggaaccuguguugauccccuuaccugauguuaggaauaacuucuaucauuauaaucagucaagugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacggguccuagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagccccuacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7422 - RNA, 1617 nt, Artificial Sequence
  VP1__Norovirus_and/or_Norovirus-like__FJ411172
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguuuacaguguccccuagaaacgcuccaggugagauacuauggagugcgcccuugggcccugauuugaacccuuaccuuucucauuuggccagaauguacaaugguuaugcaggugguuuugaagugcagguaauccuugcggggaacgcguucaccgccggaaaaaucauauuugcagcagucccaccaaacuuuccaacugaaggcuugagccccagccagguuacuauguucccccacauaauaguagauguuaggcaauuggaaccuguguugauccccuuaccugauguuaggaacaauuucuaccacuacaaccaaucaaaugacccuaccauuaaauugauagcaaugcuguacacaccacuuagggccaauaaugcuggggaugaugucuucacagucucuugucgaguccucacgaggccauccccugauuuugauuucauauuucugguaccgccaacaguugaaucaagaaccaaaccauucacugucccaaucuuaacuguugaggaaaugaccaauucaagauuccccauuccuuuggaaagguuguacacgggucccagcagugcuuuuguuguccaaccacaaaacggcaggugcacgacugauggcgugcucuuaggcacuacccagcugucugcugucaacaucugcaccuuuagaggagaugucacccacauugcaggcucucgcaauuauacaaugaauuuggccucucaaaauuggagcaacuaugacccaacagaagaaaucccagccccccugggaaccccagauuuugugggaaagauccaaggcaugcucacccaaaccacaagaagagauggcucgacccgcggccacaaagccacagugcucacugggagugccgacuuugccccaaaauugggcagaguccaauucgccacugacacagacaacgauuucgaaucuggcgaaaacacgaaauucaccccagucggcgucauccaggaugguuccaccacccaccguaaugaaccccaacaaugggugcucccaaauuacucagguagaacuggucauaaugugcaccuagccccugccguugcccccacuuacccgggugagcaacuccuuuucuucagguccacuaugcccggauguagcggguaucccaacauggaucuagauugcuugcucccccaggaaugggugcggcacuucuaccaagaagcagcuccagcacaaucugauguggcucugcuaagauuuguaaauccagacacaggcaggguucuguuugagugcaagcuccauaaaucaggauaugucacaguggcucauacuggucagcaugauuuaguuauuccccccaaugguuauuuuagauuugauuccugggucaaccaauuuuacacacuugcccccaugggaaauggagcggggcguagacguuaa

SEQ ID NO: 7423 - RNA, 1617 nt, Artificial Sequence
  VP1__Norovirus_and/or_Norovirus-like__AB447449
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggaccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccaucaaauugauagcaauguuguauacgccacuuagggcuaauaaugcuggggaagauguuuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucccgugacuacacaaugaauuuggcuucucuaaauuggaacaauuacgacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguacaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaaugugcaccuagccccugcuguagcccccacuuuuccgggugaacaacuucuuuucuucagguccacuaugcccggaugcagcggguaucccaacauggaucuggauugccuacucccccaggagugggugcagcacuucuaccaggaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucauuucuacacacuugcccccaugggaaauggaacggggcguagacguuaa

SEQ ID NO: 7424 - RNA, 1617 nt, Artificial Sequence
  VP1__Norovirus_and/or_Norovirus-like__AB447431
augaagauggcgucgaaugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccaggauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaauugauagcaaugcuguauacaccacuuagggcuaauaaugcuggggaugacgucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaagcuucauaaaucaggcuauguuacaguggcuuacaccggccagcaugauuuggucaucccccccaauggcuauuuuagguuugauuccuggguuaaucaauucuacacacuugcccccaugggaaauggaacggggcguagacguuaa

SEQ ID NO: 7425 - RNA, 1617 nt, Artificial Sequence
  VP1__Norovirus_and/or_Norovirus-like__EU078415
augaagauggcgucgaaugacgccaccccaucugauggguccacagccaaccucgucccagaggucaauaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaacaauuucuaucauuacaaucaaucuaaugaccccaccaucaaauugauagcaaugcuguauacaccacuuagggcuaacaaugcuggggacgaugucuucacagucucuugucgaguucucacgagaccauccccugauuuugauuucauauuuuuggugccacccacaguugagucaagaacuaaaccauucucugucccaaucuuaacuguugaggagaugaccaauucaagauucccuauuccuuuggaaaaguuguucacgggucccagcagcuccuuuguuguucaaccacaaaauggcagaugcacgacugauggcgugcucuuagguacuacccagcugucuccuguuaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggggggauggcucgacccgcggucauaaagccacagugagcacuggaaguguccacuuuacuccaaagcugggcaguguucaauucuccacugauacaagcaaugacuuugaaacuggccaaaacacgagauucaccccagucggugucguccaggaugguaguaccacccaccaaaaugaaccccaacaaugggugcucccagacuauucagguagaaauagucacaauguacaccuagccccugcuguggcccccacuuuuccgggugagcaacuucuuuucuuuagguccacuaugcccggaugcagcggguaucccaacaugaauuuggauugccuacucccccaggagugggugcagcacuucuaucaagagucagccccagcacaaucugauguggcacugcugagauuugugaauccagacacagguaggguuuuguuugagugcaagcuucauaagucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7426 - RNA, 1617 nt, Artificial Sequence
  VP1__Norovirus_and/or_Norovirus-like__AB385643
augaagauggcgucgagugacgccaacccaucugauggguccacggccaaccucgucccagaggucaacaaugagguuauggcuuuggagcccguuguuggugccgcuauugcggcaccuguagcgggccaacaaaauguaauugaccccuggauuagaaacaauuuugugcaagccccugguggagaguuuacaguauccccuagaaacgcuccaggugaaauacuauggagcgcgcccuugggcccugauuugaaccccuaccuuucccaucuggccagaauguacaaugguuaugcagguggcuuugaagugcaggugauccucgcggggaacgcguucacugccgggaaaaucauauuugcagcagucccaccaaauuuuccaacugaaggcuugagccccagccaggucacuauguucccccauaugauaguagauguuaggcaacuggaaccugugcugauccccuuaccagauguuaggaauaauuucuaucacuacaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcggguacucaagaauacacaaugaaucuggccucccaaaacuggaacaauuaugacccaacagaagaaaucccagccccucugggaacuccagacuucguggguaagauccaaggcgugcucacccaaaccacaaggggggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguagcaccacccaccaaaaugaaccccaacaauggguacucccaaauuacucagguagagauagucacaaugugcaccuagccccugccguggcccccucuuuuccgggugagcaacuucuuuucuucagguccacuaugcccggaugcagcggguaucccaacaugaauuuggauugccuacucccccaggaguggguacagcacuucuaccaagaggcagccccagcacaaucugauguggcucugcuaagauuugugaauccagacacagguaggguucuguuugaguguaagcuucauaaaucaggcuauguuacaguggcucacacuggccaacaugauuugguuaucccccccaauggcuauuuuagauuugauuccugggucaaucaguucuacacacuugcccccaugggaaauggaacggggcguagacguuaa

SEQ ID NO: 7427 - RNA, 1617 nt, Artificial Sequence
  VP1__Norovirus_and/or_Norovirus-like__AB385636
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauucgcagcagucccaccaaacuucccaacugaaggcuugagccccagccaggucacuauguucccccauauaauaguagauguuaggcaacuggaaccuguguugauccccuugccugauguuaggaauaauuucuaucauuacaaucagucaaaugaccccaccaucaaauugauagcaaugcuguauacaccacuuagggcuaacaaugcuggggacgaugucuucacagauucuugucgaguucucacgagaccaucccccgauuuugauuucauauuuuuggugccacccacaguugagucaaggacuaaaccauuuucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguaccacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggggggauggcucgacccgcggucacaaagccacagugagcacuggaaguguccacuuuaccccaaagcugggcaguguucaauucuccacugauacaagcaaugaccuugaaaccggccaaaacacgagauucaccccagucggugucguccaggaugguaguaccacucaccaaaaugaaccccaacaaugggugcucccaaacuauucagguagagacagucacaauguacaccuagccccugccguggcucccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcgcugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7428 - RNA, 1617 nt, Artificial Sequence
  VP1__Norovirus_and/or_Norovirus-like__AB385629
augaagauggcgucgaaugacgccaccccaucugauggguccacagccaaccucgucccagaggucaacaaugagguuauggcuuuggagcccguugcuggcgccgcgauugcggcaccuguagcgggccaacaaaauguaauugaccccuggauuagaaacaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccccugccugauguuaggaacaauuucuaucauuacaaucaaucaaaugaccccaccaucaaauugauagcaaugcuguauacaccacuuagggcuaacaaugcuggggacgaugucuucacagucucuugucgaguucucacgaggccaucccccgauuuugauuucauauuuuuggugccacccacaguugagucaagaacuaaaccauucucugucccaaucuuaacuguugaggagaugaccaauucaagauucccuauuccuuuggaaaaguuguuuacgggucccagcagugccuuuguuguccaaccacaaaauggcagaugcacgacugauggcgugcucuuagguacuacccaacugucuccugucaacaucugcaccuucagaggggaugucacccacauugcaaauacucaaaauuacacaaugaaucuggccucccaaaauuggaacaauuaugacccaacagaagaaaucccagccccucugggaaccccagauuuuguaggaagaauccaaggcgugcucacccaaaccacaaggggggauggcucgacccgcggucacaaagccacagugagcacuggaaguguccacuuuaccccaaagcugggcaguguucaauucuccacugauacaagcaaugaccuugaaacuggccaaaacacgagauucaccccagucggugucguccaggauggcgguaccacccaccgaaaugaaccccaacaaugggugcucccagauuauucagguagagauagucacaauguacaccuagccccugccguggcccccacuuuuccgggugagcaacuucuuuucuuuagguccaccaugcccggaugcagcggguaucccaacaugaauuuggauugccuacucccccaggagugggugcaacacuucuaucaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7429 - RNA, 1617 nt, Artificial Sequence
  VP1__Norovirus_and/or_Norovirus-like__EU839586
augaagauggcgucgaaugacgccagcccaucugauggguccacagccaaccucgucccagaggucaacaaugagguuauggcuuuggagcccguuguuggugccgcuauugcggcaccuguaacgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaaugcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaacuucuaccauuacaaucaaucaaaugacuccaccauuaaauugauagcaaugcuguacacaccacuuagggcuaauaaugcuggggaugacgucuucacagucucuugucgaguccucacgaggccaucccccgauuuugauuuuauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccagguacucguacuuacagaaugaauuuggcuucucaaaauuggaacaauuaugacccaacagaagagaucccagccccucugggaacuccagauuucgugggaaagauccaaggcaugcucacccaaacuacaaagggagacggcucgacccgcggucacaaagcuacagugagcacugggaguguugacuucacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacugcucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuuguaaauccagacacagguaggguucuguuugagugcaagcuacauaaagcaggcuaugucacaguggcucacacuggccagcaugauuugguuaucccccccaaugguuacuuuagauuugauuccugggucaaccaauucuacacacuugcccccaugggaaauggagcggggcguagacguuaa

SEQ ID NO: 7430 - RNA, 1617 nt, Artificial Sequence
  VP1__Norovirus_and/or_Norovirus-like__EU310927
augaagauggcgucgagugacgccagcccaucugauggguccacagccaaccucgucccagaggucaacaaugagguuauggcuuuggagcccguuguuggugccgcaauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuuucucauuuggccagaauguacaaugguuaugcaggugguuuugaagugcagguaauucucgcggggaacgcguucaccgccgggaaaaucauauuugcagcagucccaccaaauuucccaacugaaggcuugagccccagccaggucacuauguucccccauauaauaguagauguuaggcaacuggaaccuguguugauucccuuaccugaugucaggaauaauuucuaucacuauaaucagucaaaugaccccaccauuaaacugauagcaaugcuguacacaccacuuagggcuaauaaugcuggggaugaugucuucacagucucuugccgaguccucacgaggccauccccugauuuugauuuuauauuuuuggugccacccacaguugagucaagaaccaaaccauucaccgucccaauuuuaacuguugaggagaugaccaauucaagauuccccauuccuuuggaaaaguuguucacgggucccagcggugccuuuguuguucaaccacaaaauggcagaugcacgacugauggcgugcucuuagguacuacccaacugucuccuguuaacaucugcacuuucagaggggaugucacccacauugcaggcacucaugauuauacaaugaauuuggcuucucaaaauuggaacaauuacgacccaacagaagaaaucccagccccucugggaacuccagauuucgugggaaagauccaaggcgugcucacucaaaccacaaggggagauggcucgacccguggccacaaagccacagugagcacugggaguguccacuuuacuccaaagcugggcaguguucaauucaccacugacacaaacaaugaucuugaaacuggccaaaacacgaaauucaccccagucggugucguccaggaugguaauagugcccaccaaaaugaaccccaacaaugggugcucccaaauuacucagguagaacuggccauaauguacaccuagccccugccguagcccccacuuuuccgggugagcaacuucucuucuucagguccacuaugcccggaugcagcggguaucccaacaugaauuuggauugccuacucccccaggaaugggugcugcacuucuaccaagaggcagcuccagcacaaucugauguggcucugcugagauuugugaauccagacacagguaggguccuguuugagugcaaacuucauaaaucaggcuaugucacaguggcucacacuggcccgcaugauuuggucaucccccccaauggcuacuucagauuugauuccuggguuaaccaauucuacacgcuugcccccaugggaaauggagcggggcguagacguuaa

SEQ ID NO: 7431 - RNA, 1617 nt, Artificial Sequence
  VP1__Norovirus_and/or_Norovirus-like__AB294787
augaagauggcgucgaaugacgccagcccaucugauggguccgcagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacgguauccccuagaaacgcuccaggugaaauacuauggagcgcgcccuuaggcccugaucugaauccauaccuuucucaccuggccagaauguauaaugguuaugcaggugguuuugaagugcagguaauccucgcggggaacgcguucaccgccgggaaaaucauauuugcagcagucccaccaaauuucccaacugaaggcuugagucccagccaggucacuauguucccccauauaauaguagauguuaggcaauuggaaccuguguugauccccuuaccugauguuaggaauaauuucuaccauuauaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuucagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagauucaccccagucggugucauccaggaugguaguagugcccacagaaaugaaccccaacaauggguacucccagauuacucagguagaacuguucauaauguacaccuagccccugccguagcccccacuuuuccaggugagcaacuucuuuucuucagaucuacuaugcccggaugcaguggguaucccaauauggauuuggauugucugcucccccaggaaugggugcagcacuucuaccaagaggcagccccaucacaaucugauguggcuuugcugagauuugugaauccagacacagguaggguucuguuugagugcaagcuucauaaagcaggcuaugucacaguggcucacacuggccagcaugauuugguuaucccccccaauggcuacuuuagauuugacuccugggucaaccaguucuacacacuugcccccaugggaaauggagcggggcguagacguuaa

SEQ ID NO: 7432 - RNA, 1617 nt, Artificial Sequence
  VP1__Norovirus_and/or_Norovirus-like__AY587987
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcgccuucagaggggaugucacccacauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcccugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7433 - RNA, 1617 nt, Artificial Sequence
  VP1__Norovirus_and/or_Norovirus-like__AY502019
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguaucccccagaaacgcuccaggugaaauacuauggagcgcgcccuugggcccugaucugaaucccuaccuuucucauuuggccagaauguacaauggcuaugcagguggcuuugaagugcagguaauccuugcggggaaugcguuuaccgccgggaaaaucguauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaauguuguacacaccacuuagggcuaauaaugcuggggaagaugucuucacagucucuugucgaguccucacgaggccaucccccgauuuugauuucauauuuuuggugccgcccacaguugagucaagaacuaaaccauucaccgucccaauuuuaacuguugaggaaaugaccaauucaagauuccccauuccuuuggaaaaguuguucacggguccuagcagugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagccccugccguagcccccacuuuuccgggugagcaacuucuuuucuucagguccacuaugcccggaugcagcggguaccccaacaugaauuuggauugccuacucccccaggaaugggugcagcacuucuaccaagaggcagcuccagcacaaucugauguggcucugcuaagauuugugaacccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7434 - RNA, 1617 nt, Artificial Sequence
  VP1__Norovirus_and/or_Norovirus-like__LC177653
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuguauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauuccaccaucaaauugauagcaaugcuguacacaccacuuagggcuaauaaugcuggggaagaugucuucacagucucuugucgaguucucacgaggccauccccugauuuugauuuuauauuuuuggugccacccacaguugagucaagaacuaaaccauuuacugucccaaucuuaacuguugaagaaaugaccaauucaagauuccccaucccuuuggaaaaguuguucacgggccccagcggugccuucauuguucaaccacaaaaugguaggugcacgacugauggcgugcucuuaggcaccacccaacugucuccugucaacaucugcaccuucagaggggaugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggagugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaaugugcaccuggccccugcuguagcccccacuuuuccgggugaacaacuucucuucuucagguccacuaugcccggaugcaguggguaccccaacauggauuuggauugccuacucccucaggagugggugcagcacuucuaccaggaggcagcuccagcacaaucugauguggcucuauugagauuugugaauccagacacggguaggguccuguuugagugcaaacuucauaaaucaggcuaugucacaguggcucacaccggccagcaugauuuagucauccccccuaauggcuauuuuagguuugauuccuggguuaaccaauucuacacacuugcccccaugggaaauggaacggggcguagacguuaa

SEQ ID NO: 7435 - RNA, 1617 nt, Artificial Sequence
  VP1__Norovirus_and/or_Norovirus-like__AB972486
augaagauggcgucgaaugacgccaacccaucugauggguccgcagccaaccucgucccagaggucaauaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguuuccccauauaauaguggauguuaggcaauuggaaccuguguugauccccuuaccugauguuaggaauaauuuuuaccacuauaaucagucaaaugauucuacuauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucuuuaaauuggaacaacuaugacccaacagaagaaauuccagccccucuagggacuccagauuucgugggaaagauccaagguaugcucacucaaaccacaaagggagauggcucgacccguggccauaaagcuacaguuuacacugggagugcccccuucacuccaaagcugggcaguguccaauucgcaacugacacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuccuuuucuuuagguccacuaugcccggaugcagcggguaucccaacauggauuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccaaugguuauuuuagguuugauuccuggguuaaccaauucuacacgcuugcccccaugggaaacggaacggggcguagacguuaa

SEQ ID NO: 7436 - RNA, 1617 nt, Artificial Sequence
  VP1__Norovirus_and/or_Norovirus-like__KR904235
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcacgcccuugggcccugauuugaaucccuaccuuucccauuuggccagaauguacaaugguuaugcaggugguuuugaagugcaggugauccucgcggggaaugcguucaccgcugggaaaaucauauuugcagcagucccaccaaauuucccaacugaagguuugagccccagccaagucacuauguucccccacauaauaguagauguuaggcaauuggaaccuguguugauccccuugcccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucuguaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaagaacagauggcucgacccgcggccacaaagcuacaguguacacugggagcgccgacuuuucuccaaaacuagguaggguucaauuugccacugacacagacaaugauuuugaaacuaaccaaaacacaaaguucaccccagucgguguuauccaggaugguagcaccacccaccgaaaugaaccccaacaaugggugcucccaaguuacucaggcagaaacacucauaaugugcaccuggcccccgcuguagcccccacuuucccgggcgagcagcuccucuucuucagaucuaccaugcccggauguagcggguaccccaacauggauuuggacugucugcucccccaggaaugggugcaguauuucuaccaggaagcagccccagcacaaucugauguggcacuguuaagguuugugaauccagacacagguaggguuuuguuugagugcaagcuucauaaaucaggcuauguuacaguggcucacacuggccaacaugauuuaguuaucccccccaauggcuauuuuagauuugauuccugggucaaccaguucuacacacuugcccccaugggaaaugggacggggcguagacguuaa

SEQ ID NO: 7437 - RNA, 1617 nt, Artificial Sequence
  VP1__Norovirus_and/or_Norovirus-like__AB933753
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuagaaccuguguugauccccuuacccgauguuaggaauaauuucuaucauuauaaucaaucaaaugaccccaccaucaaauugauagcaauguuguauacaccacuuagggcuaauaaugcuggggacgaugucuucacaguuucuugucgaguucuuacgagaccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggccccaguaguaccuuuguuguucaaccacaaaacggcaggugcacgacugauggcgugcuccuagguacuacccaacugucuccugucaacaucugcaccuuuagaggggaugucacccacauugcaggcagucguaacuacacaaugaaucuggcuucccaaaauuggaacaguuaugacccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuucgaugcuaaccaaaacacaaaguucaccccagucgguguuauccaggauggugguacugcccaccgaaaugaaccccaacaaugggugcucccaaguuacucaggcagaaauacucauaaugugcaccuggcccccgcuguagcccccacuuuuccgggugagcaacuccucuucuucagaucuaccaugcccggaugcagcggguaccccaacauggauuuggacugucugcuuccccaggaaugggugcaguauuucuaucaggaagcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagauuugauuccugggucaaccaguucuacacacuugcccccaugggaaaugggacggggcguagacguuaa

SEQ ID NO: 7438 - RNA, 1617 nt, Artificial Sequence
  VP1__Norovirus_and/or_Norovirus-like__AB933721
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccagucuuaacuguugaagaaaugaccaauucaagauuccccauuccuuuggaaaaguuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7439 - RNA, 1617 nt, Artificial Sequence
  VP1__Norovirus_and/or_Norovirus-like__AB933706
augaagauggcgucuaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgcgggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuugguaccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugaugguuugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7440 - RNA, 1617 nt, Artificial Sequence
  VP1__Norovirus_and/or_Norovirus-like__AB933669
augaagauggcgucgaaugacgccaccgcaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaauugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauucaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuucagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggucagcaugauuuggucaucccccccaaugguuauuuuagguuugauuccuggguuaaucaguucuacacacuugcccccaugggaaauggaacggggcguagacguuaa

SEQ ID NO: 7441 - RNA, 1617 nt, Artificial Sequence
  VP1__Norovirus_and/or_Norovirus-like__EU921350
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucauuacaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagcuccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggaugguaguaccacccaccaaaaugaaccccaacaaugggcacucccagauuauucagguagagauagucacaaugugcaccuagccccugccguggcccccucuuuuccgggugagcaacuucuuuucuucagguccacuaugcccggaugcagcggguaucccaacaugaauuuggauugccuacucccccaggagugggugcagcauuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7442 - RNA, 1617 nt, Artificial Sequence
  VP1__Norovirus_and/or_Norovirus-like__LC005712
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaauuuacacugggagugcccccuuuacaccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguagcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7443 - RNA, 1617 nt, Artificial Sequence
  VP1__Norovirus_and/or_Norovirus-like__LC018707
augaagauggcgucgagugacgccaacccauccgauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacagaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaacgcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaauggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaucccagccccucuaggaaccccagauuuuguggggaagauucaaggcgugcucacccaaaccacaaggacagaugguucaacacgcggccacaaagcuacaguguacacugggagcgccaauuuuucuccaaaacuggguagaguucaauuugaaacugauacagaccaugauuuugaaguuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuuaguuaucccccccaaugguuauuuuagguuugauuccugggucaaccaguuuuacacgcuugcccccaugggaaauggaacggggcguaggcguuaa

SEQ ID NO: 7444 - RNA, 1617 nt, Artificial Sequence
  VP1__Norovirus_and/or_Norovirus-like__KM982955
augaagauggcgucgagugacgccaccccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaacgcuggggacgaugucuucacaguuucuugccgaguucucacgagaccaucccccgauuuugauuucauauuucuagugccacccacaguugagucaaggacuaaaccauucucugucccaguuuuaacuguugaggagaugaccaauucaagauuccccauuccuuuggaaaaguuguucacgggucccaguagugccuucguuguccaaccacaaaacggcaggugcacgacugauggcgugcuccuaggcaccacccaacugucuccugucaacaucugcaccuucaggggagaugucacccauaucacagguagucauaacuacacaaugaauuuggcuucucaaaauuggaacaauuaugacccaacagaagaaaucccagccccucugggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacaaaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcccugcuaagauuugugaauccagacacagguaggguuuuguuugaguguaagcuucauaaaucaggcuauguuacaguggcucacacuggccaacaugauuugguuauccccccaaaugguuauuuuagguuugauuccugggucaaccaguuuuacacgcuugcccccaugggaaauggaacggggcguagacguuaa

SEQ ID NO: 7445 - RNA, 1617 nt, Artificial Sequence
  VP1__Norovirus_and/or_Norovirus-like__KM982949
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaccccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguuuccccauauaguaguagauguuaggcaacuagaaccuguguugauucccuuacccgauguuaggaauaacuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggaaaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcacuuucagaggagauaucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuuggaacugacacagaccaugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuccacaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7446 - RNA, 1617 nt, Artificial Sequence
  VP1__Norovirus_and/or_Norovirus-like__KM406485
augaagauggcgucgaaugacgccaacccaucugauggguccgcagccaaccucgucccagaggucaacaaugagguuauggcucuggagcccguuguuggugccgccauugcggcaccuguagcgggccagcaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacgaggacagauggcucaacacguggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7447 - RNA, 1617 nt, Artificial Sequence
  VP1__Norovirus_and/or_Norovirus-like__KM198574
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaaggugugcucacucagaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggaaugggugcagcacuucuaccaagaggcagcuccagcacaaucugauguggcucuauugagauuugugaauccagacacggguaggguccuguuugagugcaaacuucacaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7448 - RNA, 1617 nt, Artificial Sequence
  VP1__Norovirus_and/or_Norovirus-like__KM198517
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagauaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagagauauucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7449 - RNA, 1617 nt, Artificial Sequence
  VP1__Norovirus_and/or_Norovirus-like__JX439839
augaagauggcgucgagugacgccaacccaucugauggguccgcagccaaccucgucccagaggucaacaaugagguuauggcuuuggaacccguugucggugccgcuauugcggcgccuguagcgggccaacaaaauguaauugaccccuggauuagaaauaauuuuguacaagccccugguggggaguuuacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaacaacuucuaucauuauaaucagucaaaugauucuaccauuaaauugauagcaaugcuguauacaccacuuagggcuaauaacgcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucauaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaacccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacguuaa

SEQ ID NO: 7450 - RNA, 1617 nt, Artificial Sequence
  VP1__Norovirus_and/or_Norovirus-like__JX439837
augaaaauggcgucgaaugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagucccagccaggucacuauguucccccacauaauaguggauguuaggcaauuggaaccuguguugauccccuuaccugauguuaggaauaacuucuaucauuauaaucagucaaaugauucuaccauuaaauugauagcaaugcucuauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaaggugugcucacccaaaccacaaagggagauggcucgacccguggccauaaagcuacaguuuauacugggagugcccccuuuacuccaaagcugggcaguguucaauucaguacugauacagaaaaugauuuugaaacucaccaaaacacaaaauucaccccagucggcgucauccaggaugguggcaccacccaccgaaaugaaccccaacaaugggugcucccaaguuauucagguagaaauguccagaauguacaccuagccccugcuguggcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguagcucuauugagauuugugaauccagacacagguaggguccuguuugaguguaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7451 - RNA, 1617 nt, Artificial Sequence
  VP1__Norovirus_and/or_Norovirus-like__KC631815
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugauccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguagcaccacccaccaaaaugaaccccaacaauggguacucccaaauuauucagguagagauagccacaaugugcaccuagccccugcuguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagguuugauuccugggucaaccaguucuacacacuugcccccaugggaaauggaacggggcguagacguuaa

SEQ ID NO: 7452 - RNA, 1617 nt, Artificial Sequence
  VP1__Norovirus_and/or_Norovirus-like__KC409315
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaccauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaaguugggcaguguucaauucaguacugacacagaagaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7453 - RNA, 1617 nt, Artificial Sequence
  VP1__Norovirus_and/or_Norovirus-like__KC409289
augaagauggcgucgaaugacgccaacccaucugauggguccgcagccaaccucgucccagaggucagcaaugagguuauggcuuuggagcccguugucggagccgcuauugcggcgccuguagcgggccaacaaaauguaauugaccccuggauuagaaacaauuuuguacaagccccugguggagaguucacaguauccccuagaaacgcuccaggugaaauauuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagacaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaauccuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaguuccagccccucugggaacuccagauuucgugggaaagauccaaggugugcucacucaaaccacaaaaggagauggcucgacccguggccacaaagcuacaguuuacacugggagugcccccuuuacuccaaagcugggcaguguucaauucaguacugacacagaaaaugauuuugaaacucaccaaaacacaaaauucaccccaguugguguuauccaggaugguggcaccacccaccgaaaugaaccccaacaaugggugcucccaagcuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcgcaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7454 - RNA, 1617 nt, Artificial Sequence
  VP1__Norovirus_and/or_Norovirus-like__KC409278
augaagauggcgucgaaugacgccaacccaucugauggguccgcagccaaccucgucccagaggucaacaaugagguuauggcuuuggagcccguugucggugccgcuauugcggcgccuguagcgggccagcaaaauguaauugaccccuggauuaggaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauucgcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauucuaccauuaaguugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccaucccuuuggaaaaguuguucacgggccccagcggugccuuuguuguucaaccgcaaaaugguaggugcacgacugauggcgugcucuuaggcaccacccaacugucuccugucaacaucugcaccuucagaggggaugucacccacauugcagguucucgcaauuacacgaugaauuuggcuucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguccaauucagcacugauacagaaaaugauuuugaagcucaccaaaacacaaaauucaccccagucggugucauccaggaugguggcaccacccaccgaaaugaaccccaacaaugggugcucccaagcuauucagguagagauguccacaauguacaccuggccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacacuggccagcaugauuuggucaucccccccaauggcuauuuuagguuugauuccuggguuaaucaauucuacacacuugcccccaugggaaauggaacggggcguagacguuaa

SEQ ID NO: 7455 - RNA, 1617 nt, Artificial Sequence
  VP1__Norovirus_and/or_Norovirus-like__KC175402
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaacaacuucuaucacuauaaccagucaaaugauucuaccauuaaacugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagguuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaacuggaacaauuaugacccaacagaagaaauuccagcuccucuaggaacuccagauuucgugggaaagauccaaggugugcucacucaaaccacaaagggagaugguucgacccguggccauaaagccacaguuuacacugggagugcccccuuuacuccaaagcugggcaguguucaauucagcaccgacacagaaaaugauuuugaaacucaccaaaacacaaaauucaccccagucggcgucauccaggaugguagcaccacccaccgaaaugaaccucaacaaugggugcucccaaguuauucagguagaaaugucccuaauguacaccuagccccugcuguagcccccacuuuuccgggugaacaacuucucuucuuuagguccacuaugcccggaugcagcggguaucccaacauggauuuggauugccuacucccccaggagugggugcagcacuucuaccaagaggcagcuccagcacaaucugauguggcucuauuaagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7456 - RNA, 1617 nt, Artificial Sequence
  VP1__Norovirus_and/or_Norovirus-like__JX459616
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauucacugucccaaucuuaacuguugaagaaaugaccaauucaagauuccccauuccuuuggaaaaauuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccggaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7457 - RNA, 1617 nt, Artificial Sequence
  VP1__Norovirus_and/or_Norovirus-like__JX459599
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguauccccuagaaacgcuccaggugaaauauuguggagcgcgcccuugggcccugauuugaaucccuaccuuucccauuuguccagaauguacaaugguuaugcaggugguuuugaggugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugaucccuuuaccugauguuaggaacaauuucuaccacuacaaucaaucaaaugaccccaccaucaaauugauagcaaugcuguauacaccacuuagggcuaauaaugcuggggacgacgucuucacagucucuugucgaguucucacgagaccauccccugauuuugauuucauauuuuuggugccacccacaguugagucaagaacuaaaccauucucugucccaaucuuaacuguugaggagaugaccaauucaagauucccuaucccuuuggaaaaguuguucacgggucccagcagugccuuuguuguucaaccacaaaauggcaggugcacgacugauggcgugcucuuagguacuacccaacuguccccugucaacaucugcaccuucagggggaaugucaccaacauugcagguucucaaacuuacacaaugaaucuggccucccaaaauuggaacaauuaugacccaacagaagaaaucccagccccucuggguacuccagauuuuguaggaaggauccaaggcgugcucacccaaaccacaaggggggauggcucgacccgcggucacaaagccacagugagcacuggaagugccuacuuuaccccaaagcugggcaguguucaauucuccacugauacaagcacugacuuugaaacuggccaaaacacgagauucaccccagucggugucguccaggaugguagcaccacccacaaaaaugaaccccaacaaugggugcucccaagcuacucagguagagauagucacaauguacaccuagccccugcuguggccccuacuuuuccgggugagcaaauucuuuucuuuagguccacuaugcccggaugcagcggguaucccaacauggauuuggauugccuacucccccaggagugggugcagcacuucuaccaagagucagccccagcacaaucugauguggcacugcuaagauuugugaauccagacacagguaggguuuuguuugagugcaagcuccauaagucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7458 - RNA, 1617 nt, Artificial Sequence
  VP1__Norovirus_and/or_Norovirus-like__JN400603
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguaucaccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuuuagaggggaugucacccacauugcagguucucguaauuacacgaugaauuuggcuucucuaaauuggaacaauuaugacccaacagaagaaauuccagccccucuaggaacuccagauuucgugggaaagauccaaggugugcucacucaaaucacaaagggagauggcucgacccguggccauaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaaugugcaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauuaagauuuguaaauccagacacggguaggguccuguuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7459 - RNA, 1617 nt, Artificial Sequence
  VP1__Norovirus_and/or_Norovirus-like__JQ613572
augaagauggcgucgaaugacgccaacccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggggaguucacaguauccccuagaaacgcuccaggugaaacauuauggagcgcgcccuuaggcccugaccugaaucccuaccuaucucauuuggccagaauguauaaugguuaugcaggugguuuugaagugcaagugauccucgcggggaacgcguucaccgccggaaaaauuauauuugcagcagucccaccaaauuuuccaacugaaggcuugagucccagccaggucacuauguucccccauauaauaguagauguuagacaauuggaaccuguguugauccccuuaccugauguuaggaauaacuucuaucacuauaaucagucaaaugauucuaccauuaaauugauagcaaugcuguauacaccacuuagggccaauaaugccggggaugaugucuucacagucucuugucgaguccucacgaggccauccccugauuuugauuucauauuuuuggugccaccuacaguugagucaagaaccaagccauuuacugucccaaucuugacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccacauugcggguucucgcaauuacacaaugaauuuggccucucuaaauuggaacaauuaugacccaacagaagaaaucccagccccucugggaacuccagauuucgugggaaagauccaagguaugcucacucaaaccacacagggagauggcucgacccggggccauaaagccacaguuuacacugggagugccgacuucacuccaaagcugggcaguguucaauuugcuacugauacagaaaaugauuuugaaacucaccaaaauacaaaauucaccccagucggugucauccaggaugguagcaccacccaccgaaaugaaccccaacaaugggcgcucccaaguuauucagguagaagugcccauaaugugcaccuagccccugcuguagcccccaauuuuccgggugaacaacuucucuucuucagguccacuaugcccggaugcagcggguaucccaacauggauuuggauugccuacucccccaggagugggugcagcacuucuaccaagaggcagcuccagcgcaaucugauguggcucuauugagauuugugaauccagacacggguagggucuuguuugagugcaaacuucauaaaucaggcuaugucacaguggcucacaccggccaacaugauuugguuaucccccccaaugguuauuuuagguuugauuccuggguuaaucaguucuacacacuugcucccaugggaaauggaacggggcguagacguuaa

SEQ ID NO: 7460 - RNA, 1617 nt, Artificial Sequence
  VP1__Norovirus_and/or_Norovirus-like__JQ613525
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaugauucuaccauuaaauugauagcaaugcuauauacaccacuuagggccaauaaugccggggaugaugucuucacagucucuugucgaguccucacgaggccauccccugauuuugacuucauauuuuuggugccaccuacaguugagucaagaacuaagccauuuacugucccaaucuugacuguugaagaaaugaccaauucaagauuccccauuccuuuggaaaaguuguucacgggucccagcagugccuuuguuguucaaccacaaaauggcaggugcacgacugauggcgugcucuuaggcaccacccaacugucuccugucaacaucugcaccuucagaggggaugucacccacauugcggguucucguaauuacacaaugaauuuggccucucugaauuggaacaauuaugacccaacagaagaaauuccagccccccugggaacuccagauuucgugggaaagauccaaggugugcucacucaaaccacaaagggagauggcucgacccggggccauaaagcuacaguuuacacugggagugccgacuucacuccaaagcugggcaguguucaguuuaguacugauacagaaaaugauuuugaaacucaccaaaacacaaaauucaccccagucgguguuauccaggaugguagcaccacccaccgaaaugaaccccaacaaugggugcucccaaguuauucagguagaaauguccauaauguacaccuagccccugcuguagcccccaauuuuccgggugaacaacuucuuuucuucagguccacuaugcccggaugcagcggguaucccaacauggaucuggauugccuacucccccaggagugggugcagcacuucuaccaagaggcagcuccagcacaaucugauguggcucuauugagauuugugaauccagacacggguagggucuuguuugagugcaaacuucauaaaccaggcuaugucacaguggcucauaccggccaacaugauuuggucaucccccccaaugguuauuuuagguuugauuccuggguuaaucaguucuacacacuugcccccaugggaaauggagcggggcguagacguuaa

SEQ ID NO: 7461 - RNA, 1617 nt, Artificial Sequence
  VP1__Norovirus_and/or_Norovirus-like__JQ613510
augaagauggcgucgaaugacgccaacccaucugauggguccgcagccaaccucgucccagaggucaacaaugagguuauggcuuuggagcccguugucggugccgcuaucgcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucacuuggccagaauguauaaugguuaugcaggugguuuugaagugcaggugauccucgcggggaacgcguucaccgccggaaaaauuauauuugcagcagucccaccaaauuucccaacugaaggcuugagucccagccaggucacuauguucccccacauaauaguggauguuagacaauuggaaccuguguugauccccuuaccugauguuaggaauaacuucuaucacuauaaucagucaaaugauucuaccauuaaauugauagcaaugcuguauacaccacuuagggcuaacaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacgcaaugaauuuggcuucucuaaauuggaacaauuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaaguugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacgggcaggguccuguuugagugcaaacuucauaaaucaggcuaugucacaguggcucauaccggccagcaugauuuaguuaucccccccaaugguuauuuuagguuugauuccuggguuaaucaauucuacacacuugcccccaugggaaauggaacggggcguagacguuaa

SEQ ID NO: 7462 - RNA, 1617 nt, Artificial Sequence
  VP1__Norovirus_and/or_Norovirus-like__GQ856450
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuaucucauuuggccagaauguauaaugguuaugcaggugguuuugaagugcaggugauccucgcggggaacgcguccaccgccggaaaaauuauauuugcagcagucccaccaaauuuuccaacugaaggcuugagucccagccaggucacuauguuuccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuucuggugccaccuacaguugagucaagaacuaaaccauuuacugucccaauccuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguacucauaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccggucggugucauccaggaugguagcaccacccaccgaaaugaaccccaacaaugggugcucccaaguuauucagguggaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuacgucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7463 - RNA, 1617 nt, Artificial Sequence
  VP1__Norovirus_and/or_Norovirus-like__AB541296
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguauccccuagaaacgcuccaggcgagauauuguggagcgcgcccuuaggcccugaucugaaucccuaccuaucucauuuggccagaauguauaaugguuaugcaggugguuuugaagugcaggugauccucgcggggaacgcguucaccgccggaaagauuauauuugcagcagucccaccaaacuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucauccacauugcagguucucguaacuacacaaugaauuuggcugcucuaaauuggaacaauuaugacccaacagaagaaauuccagccccucuaggaaccccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccaccuuuccgggugaacaacuucuuuucuucagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuccauaaaucagguuaugucacaguggcucacaccggccagcaugacuuggucaucccccccaauggcuacuuuagguuugauuccuggguuaaucaauucuacacacuugcccccaugggaaauggaacggggcguagacguuaa

SEQ ID NO: 7464 - RNA, 1617 nt, Artificial Sequence
  VP1__Norovirus_and/or_Norovirus-like__AB541212
augaagauggcgucgaaugacgccaacccaucugauggguccgcagccaaccucgucccagaggucaacaaugagguuauggcucuggagcccguugucggugccgcuauugcggcaccuguagcgggccaacaaaauguaauugaccccuggauuagaaauaauuuuguacaagccccugguggagaguucacaguaucuccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaaccuguguugauccccuuaccugauguuaggaauaacuucuaucacuauaaucagucaaaugauucuacuauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggacgucacccacauugcaggcucucgugauuacacaaugaauuuggcuucucuaaauuggaacaauuacgacccaacagaagaaauuccagccccucuaggaacuccggauuucgugggaaagauucaaggugugcucacucaaaccacaaagggggauggcucgacccguggccauaaagcuacaguuuacacugggagugcccccuuuacuccaaagcugggcaguguucgauucaguacugauacagaaaaugauuuugaaacucaccaaaacacaaaauucaccccagucggugucauccaggacgguaguaccacccaccgaaaugaaccccaacaaugggugcucccaaguuauucagguagagauguccauaauguacaccuagccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaccaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7465 - RNA, 1617 nt, Artificial Sequence
  VP1__Norovirus_and/or_Norovirus-like__AB504321
augaagauggcgucgaaugacgccaacccaucugauggguccgcagccaaccucgucccagaggucaacaaugagguuauggcucuggagcccguugucggugccgcuauugcggcgccuguagcgggccaacaaaauauaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcucacucaaaccacaaagggggauggcucgacccguggccauaaagcuacaguuuacacuggaagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagcccccgcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuaaugagauuugugaauccagauacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7466 - RNA, 1617 nt, Artificial Sequence
  VP1__Norovirus_and/or_Norovirus-like__AB294785
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguguccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuagacaacuggaaccuguguugauccccuugccugauguuagaaauaacuucuaucauuauaaccaaucaaaugacuccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcuccuagguacuacccaacugucuccugucaacaucugcaccuucagaggggaugucacccacauugcaggcacucaaaauuacacaaugaaucuggccucccaaaauuggaacaauuaugacccaacagaagaaaucccagccccucugggaaccccagauuuuguaggaaagauccaaggcgugcucacucaaaccacaaggagggauggcucgacccgcggucacaaagccacagugagcacuggaaguguccacuucaccccaaagcugggcaguguucaauucuccacugacacaagcaaugacuuugaaacuggccaaaacacgagauucaccccagucggugucguccaggaugguaguaccacccaucaaaaugaaccccaacaaugggugcucccaaacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7467 - RNA, 1617 nt, Artificial Sequence
  VP1__Norovirus_and/or_Norovirus-like__AB294780
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgccauugggcccugaucugaaucccuaccuuucucauuuggccagaauguacaauggcuaugcagguggcuuugaagugcaggugauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccguuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucguggguaggauccaaggcaugcucacccaaacuacaaagggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccaccaugcccggaugcagcggguaccccaacaugaauuuggauugucuacucccccaggaaugggugcagcauuucuaccaagaggcagcuccagcacaaucugauguggcucugcuaagauuugugaauccagacacagguaggguucuauuugagugcaagcuucauaagucaggcuaugucacaguggcucacacuggccagcaugauuugguuaucccccccaauggcuacuuuagauuugauuccugggucaaccaguucuacacacuugcccccaugggaaaugggacggggcguagacguuaa

SEQ ID NO: 7468 - RNA, 1617 nt, Artificial Sequence
  VP1__Norovirus_and/or_Norovirus-like__AB303933
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguguccccuagaaacgcuccaggugaaauauuauggagcgcgcccuugggcccugauuugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguucucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggagaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaagucaggcuaucucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7469 - RNA, 1617 nt, Artificial Sequence
  VP1__Norovirus_and/or_Norovirus-like__AY587988
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcacuacccaacugucuccugucaacaucugcgccuucagaggggaugucacccacauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaagaaugggugcagcacuucuaccaagaggcagcuccagcacaaucugauguggcccugcuaagauuugugaauccagacacagguaggguucuauuugagugcaagcuucauaaaacaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7470 - RNA, 1617 nt, Artificial Sequence
  VP1__Norovirus_and/or_Norovirus-like__KX354103
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggaccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaacuagaaccuguguugauucccuuacccgauguuaggaauaauuuuuaucauuauaaucaaucaaaugaccccaccauuaaguugauagcaauguuguauacuccacucagggcuaacaaugcuggggaugaugucuucacaguuucuugccgaguucucacgagaccaucccccgauuuugauuucauauuucuagugccacccacaguugagucaagaacuaaaccauucucugucccaguucuaacuguugaggagaugaccaauucaagauuccccauuccuuuggaaaggcuguucacgggucccagcagugccuuuguuguucaaccacaaaacggcaggugcacgacugauggcgugcuccuaggcacuacccaacugucuccugucaauauuuguaccuucagaggagaugucacccacaucacaggcagucauaacuacacaaugaauuuggcuucucaaaauuggaacaauuaugacccaacagaagaaaucccagccccccuaggaacuccagacuuuguagggaagauucaaggcgugcucacccaaaccacaaggacagauggcucaacacgcggccacaaagccacaguguacacugggagcgccgaauuugcuccaaaacuggguagaguccaauuugaaacugacacaaaccaugauuuugaggcuaaccaaaacacaaaguucaccccagucggugucauccaagaugguagcaccacccaccgaaaugaaccccaacagugggugcucccaaguuacucaggcagaaauacucauaacgugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauauuacaguggcucacacuggccaacaugauuuggucauuccccccaaugguuauuuuagauuugauuccugggucaaccaguucuacacgcuugcccccaugggaaauggaacggggcguagacguuaa

SEQ ID NO: 7471 - RNA, 1617 nt, Artificial Sequence
  VP1__Norovirus_and/or_Norovirus-like__KX354048
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccaucaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuucgaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacacggauuuggacugucugcuuccccaggaaugggugcaguacuucuaccaagaggcagccccagcacaaucugauguggcucugcuaagauuugugaauccagacacugguaggguuuuauuugagugcaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7472 - RNA, 1617 nt, Artificial Sequence
  VP1__Norovirus_and/or_Norovirus-like__KX354047
augaagauggcgucgagugacgccagcccaucugauggguccgcagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucuccgucccaguuuuaacuguugaggagaugaccaauucaagauuccccauuccuuuggaaaaguuguucacgggucccagcagugccuuuguuguccaaccacagaacggcaggugcacgacugauggcgugcuccuaggcaccacccaacugucuccugucaacaucuguaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggucacaaagccacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuauuccccccaaugguuauuuuagauuugauuccugggucaaccaguucuacacgcuugcccccaugggaaauggagcggggcguagacguuaa

SEQ ID NO: 7473 - RNA, 1617 nt, Artificial Sequence
  VP1__Norovirus_and/or_Norovirus-like__KU985161
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccacuauuaaguugauagcaauguuguauacaccacuuagggcuaauaaugcuggggaugaugucuucacaguuucuugucggguccucacgagaccaucccccgacuuugauuucauauuccuagugccacccacaguugagucaagaacuaaaccauucucugucccaguuuugacuguugaggagaugaccaauucaagauuccccauuccuuuggaaaaguuauucacggguccuagcagugccuuuguuguccaaccacaaaacggcaggugcacgacugauggcgugcuccuaggcaccacccaacuguccccugucaacaucugcaccuucagaggagacgucacccauaucacagguagucauaacuacacaaugaaucuggcuucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugcaacugacacagaccaugauuuugaagcuaaccaaaacacaaaguucaccccagucggugucauccaagaugguagcaccacccaccgaaaugaaccccaacagugggugcucccaaguuacucaggcagaaacacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguagggucuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7474 - RNA, 1617 nt, Artificial Sequence
  VP1__Norovirus_and/or_Norovirus-like__AB972517
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaaucuuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagauaucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggauugucugcucccccaggaaugggugcagcacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaacggaacggggcguagacguuaa

SEQ ID NO: 7475 - RNA, 1617 nt, Artificial Sequence
  VP1__Norovirus_and/or_Norovirus-like__AB972494
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaguaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccaacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7476 - RNA, 1617 nt, Artificial Sequence
  VP1__Norovirus_and/or_Norovirus-like__KU311163
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaauuauauuugcugcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaagauucuaccauuaaauugauagcaaugcuguacacaccacucagggccaauaaugccggggaugacgucuucacagucucuugucgaguccucacgaggccauccccugauuuugacuucauauuucuggugccaccuacaguugagucaagaacuaagccauuuacugucccaaucuuaacuguugaagaaaugaccaauucaagauuccccauuccuuuggagaaauuguucacgggucccagcaaugccuuuguuguucaaccacaaaauggcagaugcacaacugauggcguacucuuaggcaccacccaacugucuccugucaacaucugcaccuucagaggggaugucacccaaauugcgaguacccaaacuuacacaaugaauuuggccucucuaaauuggaacaauuaugacccaacagaagagauuccagccccucugggagcuccagacuucaugggaaagauccaaggugugcucacucaaaccacaaggcaagauggcucgacccggggccauaaagcuacaguuuccacugggaguguccacuucacuccaaagcugggcaguguucgauuugacacugauacaaacaauaaccuucaaccucaucaaagcacaagauuuaccccagucggcgucauccaggauggugacacccaccaaaaugaaccccaacaaugggugcucccauguuauucagguagagaugucaacaauguacaccuagccccugcuguagcccccaguuuuccgggugaacaacuucucuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguagggucuuguuugagugcaaacuccauaaaucaggcuaugucacaguggcucauaccggccaacauaauuuggucaucccccccaaugguuauuuuagguuugauuccuggguuaaucaguucuacacacuugcccccaugggaaauggaacggggcguagacguguuuaa

SEQ ID NO: 7477 - RNA, 1617 nt, Artificial Sequence
  VP1__Norovirus_and/or_Norovirus-like__KR904236
augaagauggcgucgagugacgccaacucaucugauggguccgcagccaaccucgucccagaggucaacaaugagguuauggcucuggagcccguuguuggugccgccauugcggcaccuguggcgggccaacaaaauguaauugaccccuggauuagaaauaauuuuguacaagccccugguggagaguuuacagugucccccagaaacgcuccaggugaaauacuauggagcgcgcccuuaggcccugaucuaaaucccuaccuaucccacuuggccagaauguacaaugguuaugcaggugguuuugaagugcagguaauccucgcggggaacgcguucaccgccgguaagaucauuuuugcagcagucccaccuaauuucccaacugaaggcuugagccccagccagguuacuauguucccccauauaauaguagauguuaggcaacuagaaccuguguugauucccuuacccgauguuaggaauaauuucuaccacuauaaucaaucaaaugaccccacuaucaaguugauagcaauguuguauacaccacuuagggcuaauaaugcuggggacgaugucuucacaguuucuugucggguucucacgagaccauccccugauuuugauuucauauuuuuagugccacccacaguugagucaagaacuaaaccauucucugucccaauuuuaacuguugaggagaugaccaacucaagauuccccauuccuuuggaaaaguuguucacgggucccagcagugccuuuguuguucaaccacaaaacggcaggugcacgacugacggcgugcuccuaggcacuacccaauugucuccuguuaacaucugcaccuucagaggggaugucacccauauuacagguagucgcaauuacacaaugaauuuggccacucaaaacuggaacagcuaugacccaacagaagagaucccagccccucuaggaacuccagauuucgugggaaagauucaagguguacucacccaaaccacaaagacagauggcucgacacgcggccacaaagcuacaguguacacugggagcgccgacuuugcuccaaaauuggguagaguccaauuugccacugacacagacaaugauuuugaagcuaaccaaaacacaaaguucaccccagucggugucauccaggauggugguacuacccaccgaaaugaaccccaacagugggugcucccaaguuacucaggcagaaauacucacaaugugcauuuggcccccgcuguagcccccacuuucccgggugagcaacuucucuucuucagauccacuaugcccggaugcagcggguaucccaacauggauuuggacugccugcucccccaggaaugggugcaguacuucuaccaagaggcagccccagcacaaucugauguggcucuacuaagauuugugaacccagacacagguaggguuuuguuugaguguaagcuucauaaaucaggcuauguuacaguagcucauacugguccacaugauuugguuauccccccaaaugguuauuuuagauuugauuccugggucaaccaguuuuacacacuugcccccaugggaaaugggacggggcguagacguuaa

SEQ ID NO: 7478 - RNA, 1617 nt, Artificial Sequence
  VP1__Norovirus_and/or_Norovirus-like__KR904225
augaagauggcgucgagugacgccaacccaucugaaggguccacagccagccucgucccagaggucaacaaugaggucauggcuuuggagcccguagcuggugccgccauugcggcaccuguagcgggccaaguaaauguaauugaccccuggauuagaaauaauuuuguacaagccccugguggagaguuuacaguguccccuagaaacgcuccaggugaaauacuauggagcgcgcccuuaggcccugauuugaaucccuaccuuucucauuuggccagaauguacaaugguuaugcaggugguuuugaagugcagguaauccucgcggggaacgcguucaccgccggaaaaaucauauuugcagcagucccaccaaauuucccaacugaagguuugagccccagucaggucacuauguucccccacauaauaguagauguuaggcaauuggaaccuguguugauccccuuacccgauguuaggaauaauuucuaccauuauaaucaaucaaaugaacccaccaucaaauugguagcaauguuguauacaccacuuagggcuaacaaugccggggacgaugucuucacagucucuugucgaguacucacgagaccaucccccgauuuugauuucauauuuuuggugccacccacaguugaaucaagaacuaaaccauucucugucccaauuuuaacuguugaggagaugaccaauucaagguuccccauuccucuggaaaaguuguucacgggccccaguaguuccuuugucguucaaccacaaaacggcaggugcacgacugauggcgugcuccuagguaccacccaacugucuccugucaacaucugcaccuucagaggggaugucacccauauuucaggcagucguaaccacacaaugaauuuggccucccaaaauuggaacaguuacgauccaacagaagaaaucccagccccucuaggaacuccagauuucguggggaagauucaaggugugcucacccaaaccacaaggucagauggcucgacccgcggccacaaagcuacgguguacacugggagcgccgacuuuucuccaaaacuggguagaauucaauuugccacugacacagacaaugauuuugaaacuaaccaaaacacaaaguucaccccagucgguguuauccaggauggugguacuacccaccgaaaugaaccccaacaaugggugcucccaacuuacucaggcagaaacacccauaaugugcaccuggcccccgcuguagcccccacuuucccgggcgagcagcuccucuucuucagaucuaccaugcccggguguagcggguaucccgacauggacuuggacugucugcucccccaggagugggugcagcacuucuaccaggaggcagccccagcacaaucugauguggcucuguuaagauuugugaauccagacacagguaggguuuuguuugaguguaagcuccauaaggcaggcuauguuacaguggcucacacuggccaacaugauuugguuaucccccccaaugguuauuucagauuugauuccugggucaaccaguucuucacacuugcccccaugggaaaugggacggggcgcagacgauaa

SEQ ID NO: 7479 - RNA, 1617 nt, Artificial Sequence
  VP1__Norovirus_and/or_Norovirus-like__LC005710
augaagauggcgucgaaugacgccaacccaucugauggguccgcagccaaccucgucccagaggucaacaaugagguuauggcucuggagcccguugucggugccgcuauugcggcaccuguagcgggccaacaaaauguaauugaccccuggauuagaaauaauuuuguacaagccccugguggagaguucacaguaucuccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaaccuguguugauccccuuaccugauguuaggaauaacuucuaucacuauaaucagucaaaugauucuacuauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaccuuaacuguugaagaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggacgucacccacauugcaggcucucgugauuacacaaugaauuuggcuucucuaaauuggaacaauuacgacccaacagaagaaauuccagccccucuaggaacuccagauuucgugggaaagauucaaggugugcucacucaaaccacaaagggggauggcucgacccguggccauaaagcuacaguuuacacugggagugcccccuuuacuccaaagcugggcaguguucgauucaguacugacacagaaaaugauuuugaaacucaccaaaacacaaaauucaccccagucggugucauccaggacgguaguaccacccaccgaaaugaaccccaacaaugggugcucccaaguuauucagguagagauguccauaauguacaccuagccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7480 - RNA, 1617 nt, Artificial Sequence
  VP1__Norovirus_and/or_Norovirus-like__LC018709
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcagguggcuuugaagugcaggugauucucgcggggaaugcguucaccgccgggaaggucauauuugcagcagucccaccaaauuuuccaacugaaggcuugagccccagucagguuacuauguucccccauauaguaguagauguuaggcaacuagaaccuguguugauucccuuacccgauguuaggaauaauuuuuaucauuacaaucaaucaaaugacccuaccauuaaauugauagcaauguuguauacaccacuuagggcuaauaaugcuggggaugaugucuucacaguuucuugccgaguucuuacgagaccaucccccgauuuugauuucauauuucuagugccacccacaggugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccagcugucuccugucaacaucugcaccuucagaggagaugucacccauaccacagguagucauaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguauacugggagcgccgacuuugcuccaaaacuggguagaguucaauuuggaacugacacagaccaugaucuugaagcuaaccaaaacacaaaguucaccccaguuggugucauccaagaugguagcaccacccaccgaaacgaaccccaacagugggugcucccaaguuauucaggcagaaauacuccuaaugugcauuuggcccccgcuguggcccccacuuuuccgggugagcaacuucucuucuucagauccaccaugcccggaugcagcggguaccccaacauggauuuggauugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccuggguaaaccaguuuuacacgcuugcccccaugggaaauggaacggggcguagacguuaa

SEQ ID NO: 7481 - RNA, 1617 nt, Artificial Sequence
  VP1__Norovirus_and/or_Norovirus-like__KM198587
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaagaagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7482 - RNA, 1617 nt, Artificial Sequence
  VP1__Norovirus_and/or_Norovirus-like__KM198560
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucccauuuggccagaauguauaaugguuaugcagguggcuuugaagugcaggugauccucgcgggaaacgcguucaccgccggaaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaacgauuccaccauuaaauugauagcaaugcuguacacaccacuuagggcuaauaaugcuggggaagaugucuucacagucucuugucgaguccucacgaggccauccccugauuuugauuuuauauuuuuggugccacccacaguugagucaagaaccaaaccauuuacugucccaaucuuaacuguugaagaaaugaccaauucaagauuccccaucccuuuggaaaaguuguucacgggccccagcggugccuuuauuguccaaccacaaaaugguaggugcacgaccgauggcgugcucuuaggcaccacccaacugucuccugucaacaucugcaccuucagaggggaugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggagugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauccccccuaauggcuauuuuagguuugauuccuggguuaaccaauucuauacacuugcccccaugggaaauggaacggggcguagacguuaa

SEQ ID NO: 7483 - RNA, 1617 nt, Artificial Sequence
  VP1__Norovirus_and/or_Norovirus-like__KM198521
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcgccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7484 - RNA, 1617 nt, Artificial Sequence
  VP1__Norovirus_and/or_Norovirus-like__KM198490
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcagaugcacgacugauggcgugcucuuaggcaccacccaacugucuccugucaacaucugcaccuucagaggggauaucacccacauugcagguucucgugauuacacaaugaauuuggcaucucuaaauuggaacaauuaugacccaacagaagaaauuccagccccucugggaacuccagauuucgugggaaagauccaaggugugcucacucaaaccacaaaaagagauggcucgacccguggccauaaagcuacaguuuacacugggagugcccccuuuacuccaaagcugggcaguguucgauucaguacugacacagaaaaugauuuugaaacucaccaaaacacaaaauucaccccagucggugucauccaggaugguagcaccacccaccgaaaugaaccccaacaaugggugcucccaaguuauucagguagagauguucauaauguacaccuagccccugcuguagcccccacuuuuccgggugaacaacuucuuuucuucagguccaccaugcccggaugcagcggguaucccaacauggacuuggauugccuacucccccaggagugggugcagcacuucuaccaagaggcagcuccagcacaaucugauguggcucuacugagauuugugaauccagacacggguaggguccuguuugagugcaaacuucauaaaucagguuaugucacaguggcucacaccggucagcaugauuuggucaucccccccaauggcuauuuuagguuugauucuuggguuaaccaauucuacacacuugcccccaugggaaacggaacggggcguaggcgcuaa

SEQ ID NO: 7485 - RNA, 1617 nt, Artificial Sequence
  VP1__Norovirus_and/or_Norovirus-like__KC409241
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccaucccuuuggaaaaguuguucacgggccccaguagugccuuuguuguucaaccacaaaacggcaggugcacgaccgauggcgugcuccuagguacuacccaacugucucccgucaacaucugcaccuucagaggggacgucacccauauuccaggcagucguaacuacacaaugaauuuggccucccaaaauuggaacaguuacgacccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccacccaccgaaaugaaccccaacaaugggugcucccaaguuauucagguagagauguucauaauguacaccuagccccugcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7486 - RNA, 1617 nt, Artificial Sequence
  VP1__Norovirus_and/or_Norovirus-like__JX459625
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcuuacucaaaccacaaagggggauggcucgacucguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7487 - RNA, 1617 nt, Artificial Sequence
  VP1__Norovirus_and/or_Norovirus-like__JX459613
augaagauggcgucgaaugacgcccacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauucacugucccaaucuuaacuguugaagaaaugaccaauucaagauuccccauuccuuuggaaaaauuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccggaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7488 - RNA, 1617 nt, Artificial Sequence
  VP1__Norovirus_and/or_Norovirus-like__JX459600
augaagauggcgucgaaugacgccaacccaucugauggguccgcagcccaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaacaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccgcggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaagucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7489 - RNA, 1617 nt, Artificial Sequence
  VP1__Norovirus_and/or_Norovirus-like__JX459596
augaagauggcgucgaaugacgcccacccaucugauggguccacagccaaccucgucccagaggucaacaaugagguuauggcuuuggagcccguuguuggugccgcuauugcagcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucugaaucccuaccuuucucauuuggccagaauguacaauggcuaugcagguggcuuugaagugcagacaauccucgcggggaaugcguucaccgcugggaaaauuauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuauaaccaaucaaaugaccccaccauuaaauugauagcaaugcuguacacaccacuuagggcuaauaaugcuggggaugaugucuucacagucucuugucgaguccucacgaggccaucccccgauuuugauuuuauauuuuuggugccacccacaguugagucaagaacuaaaccauucaccgucccaauuuuaacuguugaggaaaugaccaauucaagauuccccauuccuuuggaaaaguuguucacggguccuagcagugccuuuguuguucaaccacaaaauggcaggugcacgacugauggcgugcucuuaggcacuacccaauugucuccugucaacaucugcaccuucagaggggacgucacccacauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagccacagugagcacuggggauguccacuucaccccaaagcugggcaguauccaguucaacacugauacaaacaaugauuuugaaacuggccaaaacacgaaauucaccccagucgguguuguccaggacgguaauggcacccaccaaaaugagccucaacaaugggugcucccaaguuacucagguagaacuggucauaauguacaccuagccccugccguagcccccacuuuuccgggugagcaacuucuuuucuucagguccacuaugcccggaugcagcggguaccccaacaugaauuuggauugccuacuuccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggucagcaugauuugguuaucccccccaauggcuacuuuagauuugauuccugggucaaccaauucuacacacuugcccccaugggaaaugggacggggcguagacguuaa

SEQ ID NO: 7490 - RNA, 1617 nt, Artificial Sequence
  VP1__Norovirus_and/or_Norovirus-like__JX155749
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuugugcaagccccugguggagaguucacaguguccccuagaaacgcuccaggugaaauacuauggagcgcgcccuuaggcccugaucuuaaucccuaccuaucucaucuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguggauguuagacaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuucuggugccaccuacaguugagucaagaaccaaaccauucacugucccaaucuuaacuguugaagaaaugaccaauucaagauuucccauuccuuuggaaaaauuguucacgggucccagcagugccuuuguuguucaaccacagaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacagucuacacugggagugcccccuuuacuccaaagcugggcaguguucaauucaguacugauacagaaaacgauuuugaaacucaccaaaacacaaaauucaccccagucggugucauccaggaugguggcaccacccaccgaaaugaaccccaacaaugggugcucccaaguuauucagguagaaaugucccuaauguacaucuagccccugcuguagcccccacuuuuccgggugaacaacuucuuuucuuuagguccacuaugcccggaugcagcggguaucccaacauggauuuagauugccuacucccccaggagugggugcagcacuucuaccaagaggcagcuccagcacagucugauguggcucuauugagauuugugaauccagacacggguaggguccuguuugagugcaaacuucacaaaccaggcuaugucacaguggcucauaccggccagcaugauuuggucaucccccccaaugguuauuuuagguuugauuccuggguuaaucaauucuacacacuugcccccaugggaaaugggacggggcguagacguuaa

SEQ ID NO: 7491 - RNA, 1617 nt, Artificial Sequence
  VP1__Norovirus_and/or_Norovirus-like__JQ613511
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuguggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuuuccaacugaaggcuugagccccagccaggucacuauguucccccauauaauaguagauguuaggcaacuggaaccuguguugaucccuuuacccgauguuaggaauaauuucuaucacuauaaccaaucaagugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcuggcacucaagaauacacaaugaaucuggccucccaaaacuggaacaauuaugacccaacagaagaaaucccagccccucuggggacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaucuagccccugccguggcccccucuuuuccgggugagcaacuucuuuucuucagguccacuaugcccggaugcagcggguaucccaacauggauuuggacugucuacucccccaggagugggugcagcacuucuaccaagaggcagccccagcacaaucugauguggcucugcuaagauuugugaauccagauacagguaggguucuguuugaguguaagcuucauaaaucaggcuaugucacaguggcucacacuggccaacaugauuuaguuaucccccccaauggcuauuuuagauuugauuccugggucaaccaguucuacacacuugcccccaugggaaauggaacggggcguagacguuaa

SEQ ID NO: 7492 - RNA, 1617 nt, Artificial Sequence
  VP1__Norovirus_and/or_Norovirus-like__HM802547
augaagauggcgucgagugacgccagcccaucugauggguccgcagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaacccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacuguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuucagguucucguaauuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucgguguuauccaggaugguaguagugcccacagaaaugaaccccaacaauggguacucccagauuacucaggcagaacuguucauaauguacaccuagccccugcuguagcccccacuuuuccgggugagcaacuucuuuucuucagaucuacuaugcccggauguaguggguaucccaauauggauuuggauugucuacucccccaggaaugggugcagcacuucuaccaagaggcagccccaucacaaucugauguggcuuugcugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacguuaa

SEQ ID NO: 7493 - RNA, 1617 nt, Artificial Sequence
  VP1__Norovirus_and/or_Norovirus-like__HM802544
augaagauggcgucgaaugacgccaccccaucugauggguccacagccaaccucgucccagaggucaacaaugagguuauggcuuuggagcccguuguuggugccgcgauugcggcgccuguagcgggccaacaaaauguaauugaccccuggauuagaaauaauuuuguacaagccccuggcggagaguucacaguguccccuagaaacgcuccaggugaaauauuauggagcgcgcccuugggcccugauuugaaucccuaccuuucccauuuggccagaauguacaaugguuaugcaggugguuuugaagugcaggugauccucgcggggaacgcguucaccgccgggaaaaucaucuuugcagcagucccaccaaauuucccaacugaaggcuugagccccagccaggucacuauguucccccauauaauaguagauguuaggcaacuggaaccuguguuaaucccccugccugauguuaggaauaauuucuaucacuacaaucaaucaaaugacuccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauuccccauuccuuuggaaaaguuguucacgggucccagcagugccuuuguuguucaaccacaaaauggcagaugcacgacugauggcgugcuucuagguacuacccaacugucuccugucaacaucugcaccuucagaggggaugucacccacauugcagguacucaaaauuacacaaugaaucuggccucccaaaauuggaacaauuaugacccaacagaagaaaucccagcuccucugggaaccccagauuuuguaggaaagauccaaggcgugcucacccaaaccacaaggagggacggcucgacccgcggucacaaagccacaguaagcacuggaaguguccacuucaccccaaagcugggcaguguccaauucucuacugauacaaguaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7494 - RNA, 1617 nt, Artificial Sequence
  VP1__Norovirus_and/or_Norovirus-like__GQ856456
augaagauggcgucgaaugacgccaacccaucugauggguccgcagccaaccucgucccagaggucaacaaugagguuauggcuuuggagcccguugucggagccgcuauugcggcgccuguagcgggccaacaaaauguaauugaccccuggauuagaaacaauuuuguacaagccccugguggagaguuuacaguauccccuagaaacgcuccaggugaaauacuauggagcgcgcccuugggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggguguuaggcaauuggaaccuguguugauccccuuaccugauguuaggaauaacuucuaucacuauaaucagucaaaugacucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucaaaggggaugucacccacauugcagguucucguaauuacacaaugaauuuggccucucuaaauuggaacaauuaugacccaacagaagaaaucccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucagcacugauacagaaaaugauuuugaaacucaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggauguagcggguaucccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaaugggacggggcguagacguuaa

SEQ ID NO: 7495 - RNA, 1617 nt, Artificial Sequence
  VP1__Norovirus_and/or_Norovirus-like__AB541332
augaagauggcgucgaaugacgccaacccaucugauggguccgcagccaaccucgucccagaggucaacaaugagguuauggcuuuggagcccguugucggugccgcuauugcggcgccuguagcgggccaaacaaacguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguagauguuagacaauuggaaccuguguugauccccuuaccugacguuaggaauaauuucuaucacuauaaucagucaaaugauuccaccauuaaacugauagcaaugcuguauacaccacuuagggccaauaacgcuggggaagaugucuucacagucucuugucgaguccucacgaggccauccccugauuuugauuuuauauuuuuggugccacccacaguugagucaagaacuaaaccauuuacugucccaaucuuaacuguugaagagaugaccaauucaagauuccccaucccuuuggaaaaguuguucacgggucccagcggugccuuugucguucaaccacaaaauggcaggugcacgacugauggcgugcucuuaggcaccacccaacugucuccugucaacaucugcaccuucagaggggaugucacccacauugcagguucucguaauuauacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuuuacuccaaagcugggcagcgcucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguucauaauguacaccuagccccugcuguggcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguucgauuccuggguuaaucaauucuacacacuugcccccaugggaaauggaacggggcguagacguuaa

SEQ ID NO: 7496 - RNA, 1617 nt, Artificial Sequence
  VP1__Norovirus_and/or_Norovirus-like__AB541316
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaauggauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacguuaa

SEQ ID NO: 7497 - RNA, 1617 nt, Artificial Sequence
  VP1__Norovirus_and/or_Norovirus-like__AB541238
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaguucacaguauccccuagaaacgcuccaggugaaauacuauggagcgcgcccuuaggccccgaucugaaucccuaccuaucucauuuggccagaauguauaaugguuaugcaggugguuuugaagugcaggugauccucgcggggaacgcguucaccgccggaaaaauuauauuugcagcaguuccaccaaacuuuccaacugaaggcuugagccccagucaggucacuauguucccccacauaauaguagauguuaggcaacuggaaccuguauugauccccuuaccugauguuaggaauaacuucuaucauuauaaucagucaaaugauucuaccauuaaauugauagcaaugcuguauacaccacuuagggcuaauaaugcuggggaagaugucuucacagucucuugccgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuugucguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagauguccauaauguacaccuggccccugcuguagcccccacuuuuccgggugaacaacuucuuuucuucagguccacuaugcccggaugcaguggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7498 - RNA, 1617 nt, Artificial Sequence
  VP1__Norovirus_and/or_Norovirus-like__AB535750
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugggucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccgcauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcgcuauugagauuugugaauccagacacggguaggguccuguuugagugcaagcuucacaaaucaggcuaugucacaguggcucacaccggccagcaugaucuggucaucccccccaaugguuauuuuagguuugauuccuggguuaaucaguucuacacacuugcccccaugggaaauggaacggggcguagacguuaa

SEQ ID NO: 7499 - RNA, 1617 nt, Artificial Sequence
  VP1__Norovirus_and/or_Norovirus-like__FJ538900
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuaggaacgcuccaggugaaauacuauggagcgcgcccuuggguccugaucugaaccccuaccuuucucauuuggccagaauguacaauggcuaugcagguggcuuugaagugcagguaauucuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaauaauuucuaucacuacaaccaaucaaaugaccccaccauuaaacugauagcaaugcuguacacaccacuuagggcuaauaaugcuggggaagaugucuucacagucucuugucgaguccucacgaggccaucccccgauuuugauuucauauuucuggugccacccacaguugagucaagaacuaagccauucaccgucccaauuuuaacuguugaggaaaugaccaauucaagauuccccauuccuuuggaaaaguuguucacgggucccagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccagcagaagaaaucccagccccucuggggaccccagauuuugugggaaggauccaaggugugcucacccaaacuacaaggggggauggcucuacccgcggccacaaagcuacagugagcacuggggacguccauuucacuccaaagcugggcaguauucaguucaacacugacacaaauaaugauuuugaaacuggccaaaacacgaaauucaccccagucgguguuguccaggaugguaauggcacccaccaaaaugaaccccagcaaugggugcucccaagcuacucagguagaacuggucacaauguacaccuagcccccgccguagcccccacuuuuccgggugagcaacuucuuuucuucagguccacuaugcccggaugcagcggguaccccaacaugaauuuggauugucuacucccccaggaaugggugcaacacuucuaccaagaagcagcaccagcacaaucugauguggcucugcuaagauuugugaauccagacacagguaggguucuauuugagugcaagcuucauaaaucaggcuaugucacgguggcucacacuggccagcaugauuugguuaucccccccaauggcuacuuuagauuugauuccugggucaaccaguucuacacacuugcccccaugggaaaugggacggggcguagacguuaa

SEQ ID NO: 7500 - RNA, 1617 nt, Artificial Sequence
  VP1__Norovirus_and/or_Norovirus-like__EU876889
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaagcuguucacgggucccagcagugccuuuguuguucaaccacaaaauggcagguguacgacugauggcgugcucuuagguacuacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcaccggaaguguccacuucaccccaaagcugggcagaauucaauucuccacugauacaagcaaugauuuugaaacuggccaaaacacgagauucaccccagucgguguuguccaagauggugguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcccacacuggccaacaugauuuaguuaucccccccaauggcuauuuuagauuugauuccugggucaaccaguucuacacacuugcccccaugggaaauggaacggggcguagacguuaa

SEQ ID NO: 7501 - RNA, 1617 nt, Artificial Sequence
  VP1__Norovirus_and/or_Norovirus-like__EU876887
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaagaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagcgccuuuguugugcaaccacaaaauggcaggugcacgacugauggcgugcucuuagguacuacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucgugggcaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaguuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuugguuaucccccccaauggcuauuuuagauuugauuccugggucaaccaguucuacacacuugcccccaugggaaauggagcggggcguagacguuaa

SEQ ID NO: 7502 - RNA, 1617 nt, Artificial Sequence
  VP1__Norovirus_and/or_Norovirus-like__FJ411171
augaagauggcgucgaaugacgccaacccaucugauggguccacagccaaccucgucccagaggucaacaaugagguuauggcuuuggagcccguuguaggugccgcuauugcggcgccuguagcgggccaacaaaauguaauugaccccuggauuagaaauaauuuuguacaagccccugguggagaguucacaguguccccuagaaacgcuccaggugagauacuauggagugcgcccuugggcccugauuugaacccuuaccuuucucauuuggccagaauguacaaugguuaugcaggugguuuugaagugcagguaauccuugcggggaacgcguucaccgccggaaaaaucauauuugcagcagucccaccaaacuuuccaacugaaggcuugagccccagccagguuacuauguucccccauaugauaguagauguuaggcaauuggaaccuguguuaaucccuuuaccugauguuaggaacaauuucuaucacuacaaccaaucaaaugacccuaccauuaaauugauagcaaugcuguacacaccacuuagggccaauaaugcuggggaugaugucuucacagucucuugucgaguccucacgaggccauccccugauuuugauuucauauuucugguaccgccaacaguugaaucaagaaccaaaccauucacugucccaaucuuaacuguugaggaaaugaccaauucaagauuccccauuccuuuggaaagguuguacacgggucccagcagugcuuuuguuguccagccacaaaacgguaggugcacgacugauggcgugcucuuaggcacuacccagcugucugcugucaacaucugcaccuuuagaggagaugucacccacauugcaggcucucgcaauuauacaaugaauuuggccucucaaaauuggagcaacuaugacccaacagaagaaaucccagccccccugggaaccccagauuuugugggaaagauccaaggcaugcucacccaaaccacaagaagagauggcucgacccgcggccacaaagccacagugcucacugggagugccgacuuugccccaaaauugggcagaguccaauucgccacugacacagacaacgauuucgaaucuggcgaaaacacgaaauucaccccagucggcgucauccaggaugguuccaccacccaccggaaugaaccccaacaaugggugcucccaaauuauucagguagaacuggucauaaugugcaccuagccccugccguugcccccacuuacccgggugagcaacuccuuuucuucagguccacuaugcccggauguagcggguaucccaacauggaucuagauugcuugcucccccaggaaugggugcggcacuucuaccaagaagcagcuccagcacaaucugauguggcucugcuaagauuugugaauccagacacagguaggguucuguuugagugcaagcuccauaaaucaggguaugucacaguggcucauacuggucagcaugauuuaguuauuccccccaaugguuauuuuagauuugauuccugggucaaccaauuuuacacacucgcccccaugggaaauggagcggggcguagacguuaa

SEQ ID NO: 7503 - RNA, 1617 nt, Artificial Sequence
  VP1__Norovirus_and/or_Norovirus-like__AB447460
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguuuaccgccggaaaaauuauauuugcagcagucccaccaaauuuuccaacugaaggcuugagucccagccaggucacuauguucccccacauaauaguagauguuagacaauuggaaccuguguugauccccuuaccugauguuaggaauaauuuuuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaguuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaacguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauuccccccaauggcuauuuuagguuugauuccuggguuaaucaauucuacacacuugcccccaugggaaauggaacggggcgcagacguuaa

SEQ ID NO: 7504 - RNA, 1617 nt, Artificial Sequence
  VP1__Norovirus_and/or_Norovirus-like__AB447454
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcucacucaaaccacaaagggggauggcucgacccguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuguuugaguguaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7505 - RNA, 1617 nt, Artificial Sequence
  VP1__Norovirus_and/or_Norovirus-like__AB447443
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaacuuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaacccagacacggguaggguccuguuugagugcaaacuucauaaaucaggcuaugucacaguggcucacaccggccagcaugauuuggucaucccccccaauggcuauuuuagguuugauuccuggguuaaucaauucuauacacuugcccccaugggaaauggaacggggcguagacguuaa

SEQ ID NO: 7506 - RNA, 1617 nt, Artificial Sequence
  VP1__Norovirus_and/or_Norovirus-like__AB447430
augaagauggcgucgaaugacgccaacccaucugauggguccacagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcaaaagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaacugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacucaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7507 - RNA, 1617 nt, Artificial Sequence
  VP1__Norovirus_and/or_Norovirus-like__EU078420
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgccauuaggcccugaucugaaucccuaccuaucucauuuggccagaauguauaaugguuaugcaggugguuuugaagugcaggugauccuugcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgaccgauggcgugcucuuaggcaccacccaauugucuccugucaacaucugcaccuucagaggggaugucacccacauugcagguucucguaauuacacaaugaauuuggcuucucuaaacuggaacaauuaugacccaacagaagaaauuccagccccucuaggaacuccagauuucguaggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccuggugaacaacuucuuuucuuuagguccacuaugcccggaugcagcggguaucccaacauggauuuggauugccuacucccccaggagugggugcagcacuuccaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaguucuacacacuugcccccaugggaaauggaacggggcguagacguuaa

SEQ ID NO: 7508 - RNA, 1617 nt, Artificial Sequence
  VP1__Norovirus_and/or_Norovirus-like__AB385637
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaaugaccccaccaucaaauugauagcaauguuguauacaccacuuagggcuaauaaugcuggggaugaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguacuacccaacugucuccugucaacaucugcaccuucagaggggaugucacccacauugcugguacccaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucucuacugauacaagcaaugauuuugaaacuggccaaaacacgagauucaccccagucgguguuguccaggaugguaguaccacccaccaaaaugaaccccaacaauggguacucccaaauuauucagguagagauggccacaaugugcaccuagccccugccguggcccccucuuuuccgggugagcaacuucucuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7509 - RNA, 1617 nt, Artificial Sequence
  VP1__Norovirus_and/or_Norovirus-like__EF202568
augaagauggcgucgaaugacgccaccccaucugauggguccgcagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauucccuugccugauguuaggaacaauuucuaucauuacaaucaaucaaaugaccccaccaucaaacugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcaguuccuuuguuguucaaccacaaaauggcagaugcacgacugauggcgugcucuuagguacuacccaacugucucccgucaacaucuguaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucauaaagccacagugagcacuggaaguguccacuuuacuccaaagcugggcaguguucaauucuccacugauacaagcaaugacuuugaaaccggccaaaacacgagguucaccccagucggugucguccaggaugguaguaccaccccccaaaaugaaccccaacagugggugcucccagacuauucagguagagauagucacaauguacaccuagccccugcuguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacuacugagauuugugaauccagacacagguaggguucuguuugagugcaagcuucauaaaucaggcuauguaacaguggcccacacuggccaacaugauuugguuaucccccccaauggcuauuuuagauuugauuccugggucaaccaauucuacacacuugcccccaugggaaauggagcggggcguagacguuaa

SEQ ID NO: 7510 - RNA, 1617 nt, Artificial Sequence
  VP1__Norovirus_and/or_Norovirus-like__AB294781
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgccauugggcccugaucugaaucccuaccuuucccauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugacccuaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaguuuuaacuguugaggaaaugaccaauucaagauuccccauuccguuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaagggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccaccaugcccggaugcagcggguaccccaacaugaauuuggauugucuacucccccaggaaugggugcagcauuucuaccaagaggcagcuccagcacaaucugauguggcucugcuaagauuugugaauccagacacagguaggguucuauuugagugcaagcuucauaagucaggcuaugucacaguggcccacacuggccagcaugauuugguuaucccccccaauggcuacuuuagauuugauuccugggucaaccaguucuacacacuugcccccaugggaaaugggacggggcguagacguuaa

SEQ ID NO: 7511 - RNA, 1617 nt, Artificial Sequence
  VP1__Norovirus_and/or_Norovirus-like__AB303940
augaagauggcgucgaaugacgccaccccaucugauggguccacagccaaccucgucccagaggucaacacugagguuauggcuuuggagcccguuguuggcgccgcgauugcggcaccuguagcgggccaacaaaauguaauugaccccuggauuagaaauaauuuugugcaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucacuacaaucaaucaaaugaccccaccaucaaauugauagcaaugcuguauacaccacuuaggacuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguauccacuuuaccccaaagcugggcaguguucaauucuccacugauacaagcaaugacuuugaaacuggccaaaacacgagauucaccccagucggugucguccaggauggcaguaccacccaccaaaaugaaccccaacaaugggugcucccagacuauucagguagagauagucacaauguacaccuagccccugccguggcccccacuuuuccgggugagcaacuucuuuucuuuagguccaccaugcccggaugcagcggguaucccaacaugaauuuggauugccuacucccccaggagugggugcaacacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7512 - RNA, 1617 nt, Artificial Sequence
  VP1__Norovirus_and/or_Norovirus-like__DQ415279
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucugaaucccuaccuuucucauuuagccagaauguacaauggcuaugcagguggcuuugaagugcagguaauccuugcggggaaugcguucaccgccgggaaaaucauauuugcagcagucccaccaaauuucccaacugaaggcuuaagccccagccaggucacuauguucccccauguaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuaguggugccuuuguuguucaaccacaaaauggcagguguacgacugauggcgugcucuuaggcacuacccaacugucuccugucaacaucugcaccuucagaggggaugucacccauauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucaccccaaagcugggcaguauucaguucaacacugauacaaacaaugauuuugaaacuggucaaaacacgaaauucaccccagucgguguuguccaggaugguaaugguacccaccaaaaugaaccucaacaaugggugcucccaagcuacucagguagaacuggccauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugacuccugggucaaccaauucuacacacuugcccccaugggaaaugggacggggcguagacguuaa

SEQ ID NO: 7513 - RNA, 1617 nt, Artificial Sequence
  VP1__Norovirus_and/or_Norovirus-like__DQ078794
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaacuucccaacugaagucuugagccccagccaggucacuauguucccccauauaauaguagauguuaggcaacuggaaccuguguugaucccccugccugauguuaggaauaaucucuaucauuacaaucaaucaaaugaccccaccaucagauugauagcaaugcuguauacaccacuuagggcuaacaaugcuggggacgaugucuucacagucucuugucgaguucucacgagaccaucccccgauuuugauuucauguuuuuggugccacccacaguugagucaagaacuaaaccauucucugucccaaucuuaacuguugaggagaugaccaauucaagauuccccauuccuuuggaaaaguuguucacgggucccagcagugccuuuguuguucaaccacaaaauggcagaugcacgacugauggcgugcucuuggguacuacucaacugucuccugucaacaucugcaccuucagaggggaugucacccacauugcaggugcucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuuuaccccaaagcugggcaguguucaauucucuacugauacaagcaaugacuuugaaacuggccaaaacacgagauucaccccagucggugucguccaggaugguaguaccacccaccaaaaugaaccccaacaaugggugcucccagacuauucagguagagauagucacaauguacaccuagccccugccguggcccccacuuuuccgggcgagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccuggaucaaccaauucuacacacuugcccccaugggaaauggagcggggcguagacguuaa

SEQ ID NO: 7514 - RNA, 1617 nt, Artificial Sequence
  VP1__Norovirus_and/or_Norovirus-like__KP784691
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggugaguuuacaguauccccuagaaacgcuccaggugaaauacuauggagcgcgcccuugggcccugauuugaaccccuaccuuucccauuuagccaggauguacaauggcuacgcaggugguuuugaagugcagguaauccucgcggggaaugcguucaccgccggaaaaauuauauuugcagcagucccaccaaacuucccaacugaaggcuugagccccagccaggucacuauguuuccccauauaauaguagauguuaggcaauuggaaccugugcugauccccuuaccugauguuaggaacaauuucuaucauuacaaucaaucaaaugaccccaccaucaaauugauagcaaugcuguacacaccacuuagggcaaacaaugcuggagaugaugucuuuacagucucuugucgaguccucacgagaccaucccccgauuuugauuucauauuucuggugccacccacaguugagucaagaacuaaaccauucucugucccaauuuuaacuguugaagagaugaccaauucaagauuccccaucccuuuggaaaaguuguuuacgggucccagcagugccuuuguuguucaaccacaaaauggcagaugcacgacugauggcgugcucuuagguacuacccaacugucuccugucaacaucugcaccuucagaggggaugucacccacauugcagguacccacaauuacacaaugaaucuggccucccaaaauuggaacaauuaugacccaacagaagaaaucccagcuccucugggaacuccagauuucgugggaaagauccaaggcguacucacccaaaccacaaggggggauggcucgacccgcggucacaaggcuacagugagcacuggggacgcccacuucaccccaaagcugggcaguguuauguucuccacugauacaaacaaugacuuugaaacuggccaaaacacgagauucaccccagucggugucguccaggacgguagcaccacccaccaaaaugaaccccaacaauggguucucccaagcuacuuagguagagacagucacaaugugcauuuagccccugccguggcccccucuuucccgggugagcaacuucuuuucuucagguccacuaugcccggaugcagcggguaucccaacaugaacauggauugccuacucccccaagagugggugcagcacuucuaucaagaggcagccccagcgcaaucugauguggcucuacugagauuugugaauccagacacagguaggguucuguuugagugcaagcuucauaaaucagguuaugucacaguggcccacacuggccaacaugauuuaguuauuccccccaaugguuauuuuagauuugauucuugggucaaccaauucuacacucuugcccccaugggaaauggaacggggcgcagacgauaa

SEQ ID NO: 7515 - RNA, 1617 nt, Artificial Sequence
  VP1__Norovirus_and/or_Norovirus-like__KX907727
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaauaauuuuguacaagccccugguggggaguuuacaguauccccuagaaacgcuccaggugaaauacuauggagcgcgccccuaggcccugaccuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaaguccuagccaggucacuauguucccccauauaauaguggauguuagacaauuagaaccugugcugauucccuuacccgaugucaggaauaauuucuaucauuacaaucagucaaaugaucccacuauuaaguugauagcaauguuguauacaccacuuagggcuaauaaugcuggggaugauguuuucacaguuucgugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuucuaggcaccacccaacugucuccugucaacaucugcaccuucagaggggaugucacccacaucacagguagucgcaacuacacaaugaauuuggcuucucaaaauuggaacaacuaugacccaacagaagaaaucccagccccucuaggaacuccagauuuuguggggaagauccaaggcaugcucacccaaaccacaaggacagaugguucaacacgcggccacaaagcuauaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaacgaaccccaacagugggugcucccaaguuacucaggcagaaauacucacaauguacaucuggccccugcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguuaa

SEQ ID NO: 7516 - RNA, 1617 nt, Artificial Sequence
  VP1__Norovirus_and/or_Norovirus-like__KX354049
augaagauggcgucgagugacgccaacccaucugauggguccgcagccaaccucgucccagaggucaacaaugagguuauggcucuggagcccguuguuggugccgccauugcggcaccuguagcgggccaacaaaauguuauugaccccuggauuagaaacaauuuuguacaagccccugguggagaguuuacaguaucccccagaaacgcuccaggugaaauacuauggagcgcgcccuuaggcccugaucuaaaucccuaccuaucccauuuggccagaauguacaaugguuaugcaggugguuuugaagugcagguaauucuugcggggaacgcguucaccgccgggaagaucauauuugcagcagucccaccaaauuucccaacugaaggcuugagccccagccaggucacuauguucccccauauaauaguagauguuaggcaacuagaaccuguguugauucccuuacccgauguuaggaauaauuucuaucauuacaaucaaucaaaugaucccaccauuaaguugauagcaauguuguauacaccacuuagggcuaauaaugcuggggacgaugucuucacaguuucuugccgaguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagcuccucuaggaacuccagauuuuguggggaagauucaaggugugcucacccaaaccacaagggcagauggcucgacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacaguggguacucccaaguuacucaggcagaaauacucauaaugugcaucuggcccccgcuguagcccccacuuuuccgggugagcaacuccucuucuucagauccacuaugcccggaugcagcggguaccccaacauggauuuggacugucugcuuccccaggaaugggugcaauacuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagguuugacuccuggguuaaucaguucuacacgcuugcccccaugggaaauggaacggggcguagacguuaa

SEQ ID NO: 7517 - RNA, 1617 nt, Artificial Sequence
  VP1__Norovirus_and/or_Norovirus-like__KX354024
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauccucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuaguaccacccacaguugagucaagaacuaaaccauucucugucccaguuuuaacuguugaggagaugaccaauucaagauuccccaucccuuuggaaaagcuguucacgggucccagcagugccuuuguuguccaaccacaaaacggcaggugcacgacugauggcgugcuccuaggcaccacccaacugucuccugucaacaucugcaccuucagaggagaugucacccacaccacagguagucguaacuacacaaugaauuuggcuucucaaaauuggaacaauuaugacccaacagaagaaaucccagccccucuaggaacuccagacuuuguggggaagauucaaggugugcucacccaaaccacaaggacagauggcucaacacgcggucacaaagccacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7518 - RNA, 1617 nt, Artificial Sequence
  VP1__Norovirus_and/or_Norovirus-like__KX353955
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggggaguucacaguauccccuagaaacgcuccaggugaaauacuauggagcgcgcccuuaggcccugaucugaaucccuaccuaucucauuuggccagaauguauaaugguuaugcagguggcuucgaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuacaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuugggcaccacccaacugucuccugucaauaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaucaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7519 - RNA, 1617 nt, Artificial Sequence
  VP1__Norovirus_and/or_Norovirus-like__AB972518
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagugccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaacuacuccuaaugugcaucuggcccccgcuguagcccccacuuuuccgggugagcaacuucucuucuucagauccaccaugcccgggugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7520 - RNA, 1617 nt, Artificial Sequence
  VP1__Norovirus_and/or_Norovirus-like__AB933744
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuagaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucuuacgagaccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggccccaguaguaccuuuguuguucaaccacaaaacggcaggugcacgacugauggcgugcuccuagguacuacccaacugucuccugucaacaucugcaccuuuagaggggaugucacccacauugcaggcagucguaacuacacaaugaaucuggcuucccaaaauuggaacaguuaugacccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuucgaugcuaaccaaaacacaaaguucaccccagucgguguuauccaggauggugguacugcccaccgaaaugaaccccaacaaugggugcucccaaguuacucaggcagaaauacucauaaugugcaccuggcccccgcuguagcccccacuuuuccgggugagcaacuccucuucuucagaucuaccaugcccggaugcagcggguaccccaacauggauuuggacugucugcuuccccaggaaugggugcaguauuucuaucaggaagcagccccagcacaaucugauguggcucugcuaagauuugugaauccagacacagguaggguuuuguuugaguguaagcuucauaaaucaggcuaugcuacaguggcccacacuggccaacaugauuugguuaucccccccaaugguuauuuuagauuugauuccugggucaaccaguucuacacacuugcccccaugggaaaugggacggggcguagacguuaa

SEQ ID NO: 7521 - RNA, 1617 nt, Artificial Sequence
  VP1__Norovirus_and/or_Norovirus-like__AB933673
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggccaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaaugguuauuuuagguuugauuccuggguuaaucaauucuacacgcuugcccccaugggaaauggaacggggcguagacguuaa

SEQ ID NO: 7522 - RNA, 1617 nt, Artificial Sequence
  VP1__Norovirus_and/or_Norovirus-like__KM245070
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcaacacuucuaccaagaggcagcuccagcacaaucugacguggcucuauugagguuugugaacccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7523 - RNA, 1617 nt, Artificial Sequence
  VP1__Norovirus_and/or_Norovirus-like__EU921382
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuauaaucaguuaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugauguggcccuauugagauucgugaauccagacacggguaggguccuguuugagugcaaacuucauaaaucaggcuaugucacaguggcucauaccggccagcaugauuuggucaucccccccaauggcuauuuuagguuugauuccuggguuaaucaauucuacacacuugcccccaugggaaauggaacggggcguagacguuaa

SEQ ID NO: 7524 - RNA, 1617 nt, Artificial Sequence
  VP1__Norovirus_and/or_Norovirus-like__KP293589
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucaccauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggccaauaaugcuggggaugaugucuucacaguuucuugccgaguucucacgagaccaucccccgauuuugauuuuauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuuccgaggagaugucacccauaucacagguagucgcaacuacacaaugaauuuggcuucucaaaauuggagcaacuaugacccaacagaagauaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacgaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7525 - RNA, 1617 nt, Artificial Sequence
  VP1__Norovirus_and/or_Norovirus-like__KP241908
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaacuagaaccuguguugauucccuuacccgauguuaggaauaauuucuaccauuacaaucaaucaaaugaccccaccauuaaguugauagcaauguuguauacaccacucagggcuaauaaugcuggggaugaugucuucacaguuuccugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugauccaacagaagaaaucccagccccucuaggaacuccagauuuuguggggaagauucagggcgugcucacccaaaccacaaggacagauggcucaacacgcggccacaaagccacaguguacacugggagcgccgacuuugcuccaaaacuggguagaguucaauuugaaacugacacaaaccaugauuuugaagcuaaccaaaacacaaaguucaccccaguuggugucauccaagaugguagcaccacccaccgaaaugaaccccaacagugggugcucccaaguuacucaggcagaaauacucccaaugugcaucuggcccccgcuguagcccccacuuuuccgggugagcaacuucuuuucuucagauccaccaugcccggaugcagcggguaccccaacauggauuuggacugucugcucccccaggaaugggugcaguacuucuaccaagaggcggccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacguuaa

SEQ ID NO: 7526 - RNA, 1617 nt, Artificial Sequence
  VP1__Norovirus_and/or_Norovirus-like__KJ451059
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuaguaccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccagaccacaaggacagauggcucaacacgcggccacaaagccacaguguacacugggagcgccgacuuugcuccaaaacuggguagaguucaauuugaaacugacacagaccgugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7527 - RNA, 1617 nt, Artificial Sequence
  VP1__Norovirus_and/or_Norovirus-like__KM198570
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaauaauuuuguacaagccccugguggagaguucacaguauccccuagaaacgcuccaggugaaauacuauggggcgcgcccuuaggcccugaccugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccucuggaaaaguuguucacgggucccagcggugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccaccaugcccggaugcagcggguaucccaauauggauuuggauugccuacucccccaggagugggugcagcacuucuaccaagaggcagcuccagcacaaucugauguggcucuacugagauuugugaauccagacacggguaggguccuguuugagugcaaacuucauaaaucagguuaugucacaguggcucacaacggucagcaugauuuggucaucccccccaauggcuauuuuagguuugauuccuggguuaaucaauucuacacacuugcccccaugggaaacggaacggggcguaggcgcuaa

SEQ ID NO: 7528 - RNA, 1617 nt, Artificial Sequence
  VP1__Norovirus_and/or_Norovirus-like__KM198558
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaagucacuauguucccccacauaauaguagauguuaggcaauuggaaccuguguugauccccuuaccugauguuaggaauaacuucuaucauuauaaucagacaaaugauccuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccaucccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaaggugugcucacucaaaccacaagaggagauggcucgacccguggccauaaagcuacaguuuacacugggagugcccccuuugcuccaaaacugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguucgagugcaaacuucauaaaucaggcuaugucacaguggcucacaccggucagcaugauuuggucauccccccuaauggcuauuuuagguuugauucuugggucaaucaguucuacacgcuugcccccaugggaaacggaacggggcguaggcgcuaa

SEQ ID NO: 7529 - RNA, 1617 nt, Artificial Sequence
  VP1__Norovirus_and/or_Norovirus-like__AB447456
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaagucacuauguucccccacauaauaguagauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcagacguuaa

SEQ ID NO: 7530 - RNA, 1617 nt, Artificial Sequence
  VP1__Norovirus_and/or_Norovirus-like__KF177444
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaauagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuucgauuucauauuucuagugccacccacaguugagucaagaacuaaaccauucucugucccaguuuuaacuguugaggagaugaccaauucaagauuccccauaccuuuggaaaaguuguucacgggucccagcagugccuuuguuguccaaccacaaaacggcaggugcacgacugauggcgugcuccuaggcaccacccaacugucuccugucaacaucuguaccuucagaggagaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7531 - RNA, 1617 nt, Artificial Sequence
  VP1__Norovirus_and/or_Norovirus-like__KF429776
augaagauggcgucgaaugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaccccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaugaugucuuuacaguuucuugucgaguucucacgagaccaucccccgauuuugauuucauauuuuuagugccaccuacaguugaaucaagaacuaaaccauucucugucccaauuuuaacuguugaagaaaugaccaauucaagguuccccauuccuuuggaaaaguuguucacgggccccaguaguaccuuuguuguucaaccacaaaacggcaggugcacgacugauggcgugcuccuagguaccacccaacugucuccugucaacaucugcaccuucagaggggaugucacccacauugcaggcagucguaacuacacaaugaaccuggcuucccaaaauuggaacaguuaugacccaacagaagaaaucccagccccucuaggaacuccagauuucguggggaagauucaaggugugcucacucaaaccacaaggacagauggcucgacccgcggccacaaagcuacaguguacacugggagcgccgacuuuucuccaaaacuggguagaguucaauuugccacugacacagacaaugauuucgaugcuaaccaaaacacuaaguucaccccagucgguguuauccaggaugguggcacugcccaccgaaaugaaccccaacaaugggugcucccaaguuacucaggcagaaacacucauaaugugcaccuggcccccgcuguagcccccacuuuuccgggugagcaacuccucuucuucagaucuaccaugccaggaugcagcggguaccccaacauggauuuggacugucugcucccccaggaaugggugcaguauuucuaccaggaagcagccccagcacaaucugauguggcucugcuaagauuugugaauccagacacagguaggguucuguuugaguguaagcuucauaaaccaggcuauguuacaguggcucacacuggucaacaugauuugguuaucccccccaaugguuauuuuagauuugauuccugggucaaccaguucuacacacuugccccuaugggaaaugggacggggcguagacguuaa

SEQ ID NO: 7532 - RNA, 1617 nt, Artificial Sequence
  VP1__Norovirus_and/or_Norovirus-like__KC243078
augaagauggcgucgagugacgccaacccaucugauggguccgcagccaaccucgucccagaggucaacaaugagguuauggcucuggagcccguuguuggugccgccauugcggcgccuguagcgggccaacaaaauguaauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuucccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccagcagugggugcucccaaguuacucaggcagaaacacucauaaugugcaucuggcccccgcuguagcccccacuuuuccgggugagcaacuucucuucuucagguccaccaugcccggaugcagcggguaccccaacauggauuuggacugucugcucccccaggaaugggugcaguacuucuaccaagaggcagccccagcacaaucugaaguggcucugcuaagauuugugaauccagacacagguaggguuuuguuugaguguaagcuucauaaaucaggcuauguuacaguggcucacacuggccaauaugauuugguuauuccccccaaugguuauuuuagguuugauuccugggucaaccaguuuuacacgcuugcccccaugggaaauggaacggggcguagacguuaa

SEQ ID NO: 7533 - RNA, 1617 nt, Artificial Sequence
  VP1__Norovirus_and/or_Norovirus-like__KC409280
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaagaagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaaauucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7534 - RNA, 1617 nt, Artificial Sequence
  VP1__Norovirus_and/or_Norovirus-like__KC175357
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaucuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaccagucaaaugauucuaccauuaaacugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugacuaauucaagguuccccauuccuuuggaaaaacuguucacgggucccagcagcgccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaacuggaacaauuaugacccaacagaagaaauuccagccccucuaggaacuccagauuucgugggaaagauccaaggugugcucacucaaaccacaaagggagaugguucgacccguggccauaaagccacaguuuacacugggagugcccccuucacuccaaagcugggcaguguucaauucagcaccgacacagaaaaugauuuugaaacucaccaaaacacaaaauucaccccagucggcgucauccaggaugguggcaccacccaccgaaaugaaccucaacaaugggugcucccaaguuauucagguagaaaugucccuaauguacaccuagccccugcuguagcccccacuuuuccgggugaacaacuucucuucuuuagguccacuaugcccggaugcagcggguaucccaacauggauuuggauugccuacucccccaggagugggugcagcacuucuaccaagaggcagcuccagcacaaucugauguggcucuauuaagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7535 - RNA, 1617 nt, Artificial Sequence
  VP1__Norovirus_and/or_Norovirus-like__JX459621
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagugcgcccuugggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaacaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaauggcaggugcacaacugauggcgugcuccuagguacuacccaacugucuccugucaacaucugcaccuucagaggggaugucgcccacauugcagguacucaagaauacacaaugaaucuggccucccaaaauuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggauggugguaccacccaccaaaaugaaccccaacaauggguacucccagauuauucagguagagauagucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7536 - RNA, 1617 nt, Artificial Sequence
  VP1__Norovirus_and/or_Norovirus-like__JQ613541
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucguauuugcaguagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauugcaggcagucauaacuacacaaugaaucuggcuucccaaaauuggaacaguuaugacccaacagaggaaaucccagccccucuaggaaccccagauuucguggggaagauucaaggugugcucacccaaaccacaaggacggauggcucgacccgcggccacaaagcuacaguguacacugggagcgccgaauuuuccccaaaacuggguagaguucaauuugccacugacacaaacaaugauuuugaugcuaaccaaaacacaaaguucaccccagucggugucauccaggauggugguacuacccaccgaaaugaaccccaacaaugggugcuuccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucaggcuauguuacaguggcucacauuggccaacaugauuugguuauuccccccaaugguuauuuuagauuugauuccugggucaaccaguucuacacacuugcccccaugggaaaugggacggggcguagacguuaa

SEQ ID NO: 7537 - RNA, 1617 nt, Artificial Sequence
  VP1__Norovirus_and/or_Norovirus-like__JQ613527
augaagauggcgucgagugacgccaacccaucugauggguccacagccaaccucgucccagaggucaauaaugagguuauggcuuuggagcccguuguuggugccgccauugcggcaccuguagcgggccaacaaaauguaauugaccccuggguuagaaacaacuuuguacaagccccugguggagaguuuacaguguccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucaccauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuucuagugccacccacaguugaaucaagaacuaaaccauucucugucccaauucuaacuguugaggagaugaccaauucaagguuccccauuccuuuggaaaaguuguucacgggccccaguagugccuuuguuguucaaccacaaaacggcaggugcacgacugauggcguccuccuagguacuacccaacugucuccugucaacaucugcaccuucagaggggaugucacccauauugcaggcagucauaacuacacaaugaaucuggcuucccaaaauuggaacaguuaugacccaacagaagaaaucccagccccucuaggaacuccagauuucguggggaagauucaaggugugcucacccaaaccacaaggacggauggcucuacccgcggccacaaagccacaguguacacugggagcaccgaauuuuccccaaaacuggguagaguucaauuugccacugacacaaacaaugauuuugaugcuaaccaaaacacaaaguucaccccagucgguguuauccaggauggugguacuacccaccgaaaugaaccccaacaaugggugcuuccaaguuacucaggcagaaauacucauaaugugcaccuggcccccgcuguagcucccacuuuuccgggugagcagcuccucuucuucagaucuaccaugcccggaugcagcggguaccccaacauggauuuggacugucugcucccccaggaaugggugcaguauuucuaccaggaggcagccccagcacaaucugauguggcucugcuaagauuugugaacccagacacagguaggguuuuguuugaguguaagcuucauaaaucgggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7538 - RNA, 1617 nt, Artificial Sequence
  VP1__Norovirus_and/or_Norovirus-like__JF827296
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggcuagaauguacaaugguuaugcaggugguuuugaagugcagguaauccucgcggggaacguguucaccgccgggaaaaucauauuugcagcagucccaccaaauuucccaacugaaggcuugagccccagccaggucacuauguucccccauauaauaguagauguuaggcaacuggaaccuguguugauccccuugccugauguuaggaacaauuucuaucauuacaaucaaucaaaugaccccaccaucaaauugauagcaaugcuguauacaccacuuagggcuaacaaugcuggggacgaugucuucacagucucuugucgaguucucacgaggccaucccccgauuuugauuucauauuuuuggcgccacccacaguugagucaagaacuaaaccauucucugucccaaucuuaacuguugaggagaugaccaauucaagauucccuauuccuuuggaaaaguuguucacgggucccaguagugccuuuguuguucaaccacaaaauggcagaugcacgacugauggcgugcucuuagguacuacucaacugucuccugucaacaucugcaccuucagaggggaugucacccacaucgcagguacucaaaauuauacaaugaaucuggccucccaaaacuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguguccacuucaccccaaagcugggcaguauucaauucuccacugauacaagcaaugacuuugaaacuggccaaaacacgagauucaccccagucggugucguccaggaugguaguaccacccaccaaaaugaaccccaacaaugggugcucccagauuauucagguagagacagucacaauguacaccuagccccugccguggcccccacuuuuccgggugagcaacuucuuuucuuuagguccacuaugcccggaugcagcggguaucccaacaugaauuuggauugccuacuuccccaggagugggugcaacacuuuuaccaagagucagccccagcacaaucugauguggcacuacugagauuugugaauccagacacagguaggguuuuguuugagugcaagcuucauaaaucaggcuauguaacaguggcucacacuggccaacaugauuugguuauccccccuaauggcuauuuuagauuugauuccugggucaaccaauucuacacacuugcccccaugggaaauggagcggggcguagacguuaa

SEQ ID NO: 7539 - RNA, 1617 nt, Artificial Sequence
  VP1__Norovirus_and/or_Norovirus-like__JF713050
augaagauggcgucgaaugacgccaacccaucugauggguccgcagccaaccucgucccagaggucaacaaugagguuauggcuuuggagcccguugccggugccgcucuugcggcgccuguagcgggccaacaaaauguaauugaccccuggauuagaaauaauuuuguacaagccccugguggagaguucacaguauccccuagaaacgcuccaggugaaauacuauggagcgcgcccuuaagcccugauuugaaucccuaccuaucucauuuggccagaauguauaacaguuaugcaggugguuuugaagugcaggugauccucgcggggaacgcguucaccgccggaaaaauuauauuugcagcagucccaccaaauuuuccaauugaaggcuugagccccagucaggucacuauguucccccacauaauaguagauguuaggcaguuggaaccugugcugauucccuugccugauguuaggaacaauuucuaucauuacaaucagucaaaugagcccaccauaaaauugauagcaaugcuguacacaccacuuagggcuaauaaugcuggagaagaugucuucacagucucuugucgaguccucacgaggccauccccugauuuugauuuuauauuuuuggugccaccuacaguugagucaagaacuaaaccauucacugucccaaucuuaacuguugaagaaaugaccaauucaagauuccccaucccuuuggaaaaguuguucacgggucccagcaguagcuuuguuguucaaccacaaaauggcagaugcacgacugauggcgugcucuugggcaccacccaacugucgccugucaacaucugcaccuuuagaggggaugucacccacauugcagguucucgcaauuacacaaugaauuuggcuucuauaaauuggaacaauuaugacccaacagaagaaauuccagccccucuaggaacuccagauuucgugggaaagauccaagguaugcucacucaaaccacaaggggagacggcucgacccguggucauagagccacaguuuacacugggagugccccuuuuacuccaaagcugggcaguguucaauucacuacugacacagauaaugauuuugaaacuaaccaaaacacaaaauucaccccagucgguguuguccaggauggugacaccgcccaccgaaaugaaccccaacaaugggugcucccaaguuauucagguagaaauguccaaaauguacaccuagcuccugcuguagcccccacuuuuccgggugaacaacuucuuuucuucagguccacuaugcccggaugcagcggguauccuaacauggauuuggauugccuacucccucaggagugggugcagcacuucuaccaagaggcagccccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaguucuacacacuugcccccaugggaaauggaacggggcguagacgcuaa

SEQ ID NO: 7540 - RNA, 1617 nt, Artificial Sequence
  VP1__Norovirus_and/or_Norovirus-like__HM802548
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagcuccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaauugucccccgucaacaucugcaccuucagaggcgaugucacccacauuccagguacccguucuuacagaaugaauuuggcuucucaaaauuggaacaauuaugacccaacagaagaaaucccagccccucugggaacuccagauuucgugggaaagauccaaggcaugcucacccaaaccacaaagagagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauucaggaugguaguaguacccacagaaaugaaccccaacaauggguacucccagauuauucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauucgugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacguuaa

SEQ ID NO: 7541 - RNA, 1617 nt, Artificial Sequence
  VP1__Norovirus_and/or_Norovirus-like__GQ856459
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcagaugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaaccaaaccauuuacugucccaaucuuaaccguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacucacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguaccgauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugguuuggucaucccccccaaugguuauuuuagguuugauuccuggguuaaucaauucuacacacuugcccccaugggaaauggaacggggcguagacguuaa

SEQ ID NO: 7542 - RNA, 1617 nt, Artificial Sequence
  VP1__Norovirus_and/or_Norovirus-like__AB541308
augaagauggcgucgaaugacgccaacccaucugauggguccgcagccaaccucgucccagaggucaauaaugagguuauggcuuuggaucccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguggauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauguuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuucauaaaucaggcuaugucacaguggcacacaccggccagcaugauuuggucaucccccccaaugguuauuuuagguuugauuccuggguuaaucaauucuauacacuugcccccaugggaaauggaacggggcguagacguuaa

SEQ ID NO: 7543 - RNA, 1617 nt, Artificial Sequence
  VP1__Norovirus_and/or_Norovirus-like__AB541276
augaagauggcgucgaaugacgccaacccaucugauggguccgcagccagccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaauaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcuggguaguguucaauucaguacugauacagaaaaugauuuugaaacucaccaaaacacaaaauucaccccagucggugucauccaggaugguagcaccacccaccgaaaugaaccccaacaaugggugcucccaaguuacucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacucgcccccaugggaaauggaacggggcguagacguuaa

SEQ ID NO: 7544 - RNA, 1617 nt, Artificial Sequence
  VP1__Norovirus_and/or_Norovirus-like__AB541224
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacugucgaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucauccccccuaaugguuauuuuagguuugauuccuggguuaaucaguucuacacacuugcccccaugggaaauggaacggggcguagacguuaa

SEQ ID NO: 7545 - RNA, 1617 nt, Artificial Sequence
  VP1__Norovirus_and/or_Norovirus-like__AB504330
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccucauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucccuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7546 - RNA, 1617 nt, Artificial Sequence
  VP1__Norovirus_and/or_Norovirus-like__AB447445
augaagauggcgucgaaugacgccaacccaucugauggguccgcagccaaccucgucccagaggucaacaaugagguuauggcuuuggagcccguugucggugccgcuauugcagcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugacggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacucacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7547 - RNA, 1617 nt, Artificial Sequence
  VP1__Norovirus_and/or_Norovirus-like__AB294793
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucaucuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcguacucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguaugcuuacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugagccccaacaaugggugcucccaaguuauucagguagaaauguccauaauguacaccuagcccccgcuguagcccccacuuuuccgggugagcaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7548 - RNA, 1617 nt, Artificial Sequence
  VP1__Norovirus_and/or_Norovirus-like__AB303934
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccacuauuaaauuaauagcaaugcuguacacaccacuuagggcuaauaaugcuggggaagaugucuucacagucucuugucgaguccucacgaggccaucccccgauuuugauuucauauucuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacagauggcgugcucuuaggcacuacccaacuaucuccugucaacaucugcaccuucagaggggaugucacccacauugcaggcacucauaauuacacaaugaauuuggcuucucaaaauuggaacaauuaugacccaacagaagaaaucccagccccucuggggaccccagauuucgugggaaggauccaaggcaugcucacucaaaccacaaggggggauggcucuacccgcggccacaaagccacagugagcacuggggauguccacuucacuccaaagcugggcaguauucaguucaacacugauacaaacaaugauuuugaaacuggccaaaacacgaaauucaccccagucggugucauccaggaugguaauggugcccaccaaaaugaaccucaacaaugggugcucccaagcuacucagguagaacuggucauaauguacaccuagcccccgccguggccccuacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuuguaaauccagacaccgguaggguccuauuugagugcaagcuucauaaaucaggcuauaucacaguggcccacacuggucagcaugauuugguuaucccccccaauggcuacuuuagauuugauuccugggucaaccaauucuacacacuugcccccaugggaaaugggacggggcguagacguuaa

SEQ ID NO: 7549 - RNA, 1617 nt, Artificial Sequence
  VP1__Norovirus_and/or_Norovirus-like__KU678205
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagagccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacaguugagucaagaacuaaaccauucucugucccaguuuuaacuguugaggagaugaccaauucaagguuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaauuacacaaugaauuuggcuucucaaaauuggagcaauuacgacccaacagaagaaaucccagccccucuaggaacuccagacuuuguggggaagguucaaggcgugcuuacccaaaccacaaggacagauggcucaacacgcggccacaaagccacaguguacacugggagcgccgacuuugcuccaaaacuggguagaguucaauuugaaacugacacaaaccaugauuuugaagccaaccaaaacacaaaguucaccccaguuggugucauccaagaugguggcaccacccaccggaaugaaccccaacagugggugcucccaaguuacucaggcagaaauacuccuaaugugcaucuggcccccgcuguagcccccacuuuuccaggugagcaacuucucuucuucagauccaccaugcccggaugcagcggguaccccaacauggauuuggacugucugcucccccaggaaugggugcaguacuucuaccaagaggcagccccagcgcaaucugauguggcucuacuaagauuugugaauccagacacagguaggguuuuguuugaauguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7550 - RNA, 1617 nt, Artificial Sequence
  VP1__Norovirus_and/or_Norovirus-like__LC177657
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcagguggcuuugaagugcagguaauucucgcggggaaugcguucaccgccgggaaggucauauuugcagcagucccaccaaauuuuccaacugaaggcuugagccccagucaggucacuauguucccccauauaguaguagauguuaggcaacuagaaccuguguugauucccuuacccgauguuaggaauaauuucuaucauuacaaucaaucaaaugacccuaccauuaaauugauagcaauguuguauacaccacuuagggcuaauaaugcuggggaugaugucuucacaguuucuugccgaguucucacgagaccaucccccgauuuugauuucauauuucuaguaccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguauacugggagcgccgacuuugcuccaaaacuggguagaguucaauuugaaacugacacagaccgugauuuugaagcuaaccaaaacacaaaguucaccccaguuggugucauccaagaugguagcaccacccaccgaaacgaaccccaacagugggugcucccaaguuacucaggcagaaauacuccuaaugugcauuuggcccccgcuguggcccccacuuuuccgggugagcaacuucucuucuucagauccaccaugcccggaugcagcggguaccccaacauggauuuggacuguuugcucccccaggaaugggugcaguacuucuaccaagaggcagccccagcacaaucugauguggcucugguaagauuugugaauccagacacagguaggguuuuguuugaguguaagcuucauaaaucaggcuauguuacaguggcucacacuggccaacaugauuugguuaucccccccaaugguuauuuuagguuugauuccuggguaaaccaguuuuacacgcuugcccccaugggaaauggaacggggcguagacguuaa

SEQ ID NO: 7551 - RNA, 1617 nt, Artificial Sequence
  VP1__Norovirus_and/or_Norovirus-like__LC177656
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauccucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagugucuugucgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaccacagguagucauaacuacacaaugaauuuggcuucucaaaauuggagcaauuaugacccaacagaagaaaucccagccccucuaggaacuccagauuuuguggggaagauucaaggcgugcucacccaaaccacaaggauagauggcucaacacgcggccacaaagccacaguguauacugggagcgccgacuuugcuccaaaacuggguagagugcaauuugaaacugacacagaccaugauuuugaagcuaaccaaagcacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucuccuaagauuugugaauccagacacagguaggguuuuguuugaguguaagcuccauaaaucaggcuaugucacaguggcucacacuggccaacaugauuugguuaucccccccaaugguuauuuuagguuugauuccugggucaaccaguuuuacacgcuugcccccaugggaaauggaacggggcguaggcguuaa

SEQ ID NO: 7552 - RNA, 1617 nt, Artificial Sequence
  VP1__Norovirus_and/or_Norovirus-like__KX354136
augaagauggcgucgagugacgccaacccaucugauggguccgcagccaaccucgucccagaggucagcaaugagguuauggcucuggagcccguuguuggugccgccauugcggcaccuguagcgggccaacaaaauauaauugaccccuggauuagaaacaauuuuguacaagccccugguggagaguuuacaguguccccuagaaacgcuccaggugagauacuauggagcgcgcccuuaggcccugauuuaaaucccuaccuaucccauuuggcuagaauguacaaugguuaugcagguggcuuugaagugcagguaauccucgcggggaacgcguucaccgccgggaagaucauauuugcagcagucccaccaaauuuuccaacugaaggcuugagccccagccaggucacuauguucccccacauaauaguggauguuaggcaauuagaaccuguguugauucccuuaccugauguuaggaauaauuuuuaccauuauaaucaaucaaaugaccccacuauuaaguugauagcaauguuguauacaccacuuagggcuaauaaugcuggggacgaugucuucacgguuucuugccgaguucucacgagaccaucccccgauuuugauuucauauuucuagugccacccacaguugagucaagaacuaaaccauucucugucccaaucuuaacuguugaggagaugaccaauucaagauuucccauuccuuuggaaaaguuguucacgggucccagcagugccuuuguuguccaaccacaaaauggcagaugcacgacugauggcgugcuccuagguaccacccaguuaucuccugucaacauuugcaccuucagaggggaugucacccauaucacagguagccauaacuacacaaugaauuuggcuucucaaaauuggaacaauuaugacccaacagaagaaaucccagccccucuaggaacuccagacuuuguggggaagauucaaggugugcucacccaaaccacaaggucggauggcucgacacgcggccacaaagccacaguguacacugggagcgccgacuuugcuccaaaacuggguagaguucaauuugaaacugacacagaccgugauuuugaaacuaaccaaaauacaaaauucaccccagucggugucauccaagaugguaccacugcccaccgaaaugaaccucaacagugggugcucccaaguuauucaggcagaaacauucauaaugugcaccuggcccccgcuguagcccccacuuuuccgggugagcaacugcucuucuucagguccacuaugcccggaugcagcggguaucccaacauggauuuggacugucugcuuccccaggaaugggugcaguacuucuaccaagaggcagccccagcacaaucugauguggcucuguuaagauuugugaauccagacacagguaggguuuuguuugaguguaaacuucauaaaucaggcuauguuacaguggcucauacuggccaacaugauuugguuauuccccccaaugguuacuuuagauuugauuccuggguuaaucaguucuacacgcuugcccccaugggaaauggaacggggcguagacguuaa

SEQ ID NO: 7553 - RNA, 1617 nt, Artificial Sequence
  VP1__Norovirus_and/or_Norovirus-like__KX354121
augaagauggcgucgagugacgccaacccaucugauggguccgcagccaaccucgucccagaggucaacaaugagguuauggcucuggagcccguuguaggugccgccauugcggcgccuguagcgggccaacaaaauguaauugaccccuggaucagaaauaauuuuguacaagccccugguggagaguucacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaagguuugagccccagccaggucaccauguucccccauauaguaguagauguuaggcaacuagaaccuguguugauucccuuacccgauguuaggaauaauuucuaucauuauaaucaaucaaaugaccccaccauuaaguugauagcaauguuguacacaccacuuagggcuaauaaugcuggggaugaugucuucacaguuucuugccgaguucucacgagaccaucccccgauuuugauuuuauauuucuagugccacccacaguugagucaagaacuaaaccauucucugucccaguuuuaacuguugaggagaugaccaauucaagauuccccauuccuuuggaaaggcuguucacgggucccagcagugccuuuguuguucaaccacaaaacggcaggugcacgacugauggcgugcuccuaggcacuacccaacugucuccugucaacaucugcaccuucagaggagauaucacccacaucacagguagucauaacuacacaaugaauuuggcuucucaaaauuggaacaauuaugacccaacagaagaaaucccagccccccuaggaacuccagacuuuguagggaagauucaaggcgugcucacccaaaccacaaggacagauggcucaacacgcggccacaaagccacaguguacacugggagcgccgaauuugcuccaaaacuggguagaguccaauuugaaacugacacaaaccaugauuuugaagcuaaccaaaacacaaaguucaccccagucggugucauccaagaugguagcaccacccaccgaaaugaaccccaacagugggugcucccaaguuacucaggcagaaauacucacaaugugcaucuggccccugcuguagcccccacuuuuccgggugagcaacuucucuucuucagauccaccaugcccggaugcagcggguaccccaacauggauuuggacugucuacuuccccaggaaugggugcaguacuucuaccaagaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaauggcuauuuuagguuugauuccugggucaaccaguuuuacacgcuugcccccaugggaaauggaacggggcguagacguuaa

SEQ ID NO: 7554 - RNA, 1617 nt, Artificial Sequence
  VP1__Norovirus_and/or_Norovirus-like__KX354110
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggaccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaacuagaaccuguguugauucccuuacccgauguuaggaauaauuucuaucauuauaaucaaucaaaugaccccaccauuaaguuaauagcaauguuguauacuccacucagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaggcuguucacgggucccagcagugccuuuguuguucaaccacaaaacggcaggugcacgacugauggcgugcuccuaggcaccacccaacugucuccugucaacaucugcaccuucagaggagaugucacccacaucacagguagucauaacuacacaaugaauuuggcuucucaaaauuggaacaauuaugacccaacagaagaaaucccagccccccuaggaacuccagacuuuguggggaagauucaaggcgugcucacccaaaccacaaguacagauggcucaacacgcggccacaaagccacaguguacacugggagcgccgaauuugcuccaaaacuggguagaguucaauuugaaacugacacagaccaugauuuugaaacuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccaccuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauauuacaguggcucacacuggccaacaugauuugguuauuccccccaaugguuauuuuagauuugacuccugggucaaccaguucuacacgcuugcccccaugggaaauggaacggggcguagacguuaa

SEQ ID NO: 7555 - RNA, 1617 nt, Artificial Sequence
  VP1__Norovirus_and/or_Norovirus-like__KX354107
augaagauggcgucgagugacgccaacccaucugauggguccgcagccaaccucgucccagaggucaacaaugagguuauggcucuggaacccguuguuggugccgccauugcggcaccuguagcgggccaacaaaauauaauugaccccuggauuagaaacaauuuuguacaagccccugguggagaguuuacaguauccccuagaaacgcuccaggugaaauacuauggagcgcgcccuugggaccugaucuaaaucccuaccuaucccauuuggccagaauguacaaugguuaugcaggugguuuugaagugcagguaauucucgcggggaacgcguucaccgccgggaaggucauauuugcagcaguuccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaagcuguucacgggucccagcagugccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguauacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcugagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7556 - RNA, 1617 nt, Artificial Sequence
  VP1__Norovirus_and/or_Norovirus-like__KX353991
augaagauggcgucgaaugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaacaauuucuaccauuauaaucaaucaaaugaccccacuaucaaauugauagcaauguuguacacaccacuuagggcuaauaaugccggggacgaugucuucacaguuucuugucgaguucucacgagaccaucccccgauuuugacuucauauuuuuggugccacccacaguugaaucaagaacuaaaccauuuucugucccaguuuuaacuguugaggagaugaccaauucaaggauucccauuccuuuggaaaaguuguucacgggccccaguagugccuuuguuguucaaccacaaaauggcaggugcacgacugauggcgugcuccuagguaccacccaacuguccccugucaacaucugcaccuucagaggugaugucacccauauugcaggcagucgcaacuacacaaugaaucuggccucccaaaauuggaacaguuacgauccaacagaagaaaucccagccccucuagggacuccagauuucguggggaagauccaaggugugcucacccaaaccacaaggacagaugguucgacccgcggccacaaagcuacaguguacacugggagcgccgacuuuucuccaaaacuggguagaguucaauuugccacugacacagacaaugauuuugaaaccaaccaaaacacaaaguucaccccagucgguguuauacaggaugguggcaccacccaccgaaaugaaccccaacaaugggugcucccaaguuacucaggcagaaauacucacaaugugcaucuggcucccgcuguagcccccacuuucccaggcgagcagcuccucuucuucagaucuacuaugcccggaugcagcggguaccccaacauggauuuggacugucugcucccccaggaaugggugcaguauuucuaccaagaggcagccccagcacaaucugauguggcucuuuuaagguuugugaauccagacacagguaggguuuuguuugaguguaagcuccauaaaucaggcuauguuacaguggcucacacuggccaacaugauuugguuaucccccccaaugguuauuuuagauuugauucuugggucaaccaguucuacacacuugcccccaugggaaaugggacggggcgcagacguuaa

SEQ ID NO: 7557 - RNA, 1617 nt, Artificial Sequence
  VP1__Norovirus_and/or_Norovirus-like__KU985162
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccacuuggccagaauguacaaugguuaugcaggugguuuugaagugcagguaauucucgcggggaacgcguucaccgccgggaaggucauauuugcagcagucccaccaaauuuuccaacugagggcuugagccccagccaggucacuauguuuccccauauaguaguagauguuaggcaacuagaaccuguguugauucccuugcccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggaacaacuaugacccaacagaagaaaucccagccccucuaggaacuccagacuuuguggggaagauucaaggcgugcucacccaaaccacaaggacagauggcucaacacgcggccacaaagcuacaguguacacugggagcgccgauuuugcuccaaaacuggguagaguucaauuugaaacugacacaaaccaugauuuugaagcuaaccaaaacacaaaguucaccccaguuggugucauccaagaugguagcaccacccaccgaaaugaaccccaacagugggugcucccaaguuacucaggcagaaacacuccuaaugugcaucuggcccccgcuguggcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7558 - RNA, 1617 nt, Artificial Sequence
  VP1__Norovirus_and/or_Norovirus-like__AB972476
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaaucuuauggagcgcgcccuugggcccugaucugaaucccuaccuaucucauuuggccagaauguauaaugguuaugcaggugguuuugaagugcaggugauucucgcggggaacgcguucaccgccggaaaaaucauauuugcagcagucccaccaaauuuuccaacugaaggcuugagucccagucaggucaccauguucccccauauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagaaaugaccaacucaagguuccccauuccuuuggagaaguuguucacgggucccagcagugccuuuguuguucaaccacaaaauggcagaugcacaacugauggcgugcucuuaggcacuacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccaguuggugucauccaggaugguggcaccacccaccgaaaugaaccucaacagugggugcucccaaguuauucagguagaaaugucccuaauguacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcucuauugagauucgugaauccagacacggguaggguccuguuugagugcaaacuucauaaaucagguuaugucacaguggcccacaccggccagcaugauuuggucaucccccccaaugguuauuuuagguuugauuccuggguuaaccaauucuacacgcuugcccccaugggaaacggaacggggcguagacguuaa

SEQ ID NO: 7559 - RNA, 1617 nt, Artificial Sequence
  VP1__Norovirus_and/or_Norovirus-like__KU311162
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaguaacuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgcgggaaaaauuauauuugcugcagucccaccaaauuuuccaacugaaggcuugagucccagccaggucacuauguucccccacauaauaguagauguuaggcaauuggaaccuguguugauccccuuaccugauguuaggaauaacuucuaucacuauaaccagucaaaagauucuaccauuaaauugauagcaaugcuguacacaccacucagggccaauaaugccggggaugacgucuucacagucucuugucgaguccucacgaggccauccccugauuuugacuucauauuucuggugccaccuacaguugagucaagaacuaagccauuuacugucccaaucuuaacuguugaagaaaugaccaauucaagauuccccauuccuuuggagaaauuguucacgggucccagcaaugccuuuguuguucaaccacaaaauggcagaugcacaacugauggcguacucuuaggcaccacccaacugucuccugucaacaucugcaccuucagaggggaugucacccaaauugcgaguacccaaacuuacacaaugaauuuggccucucuaaauuggaacaauuaugacccaacagaagagauuccagccccucugggagcuccagacuucaugggaaagauccaaggugugcucacucaaaccacaaggcaagguggcucgacccggggccauaaagcuacaguuuccacugggaguguccacuucacuccaaagcugggcaguguucgauuugacacugauacaaacaaugaccuucaaccucaucaaagcacaagauuuaccccagucggcgucauccaggauggugacacccaccaaaaugaaccccaacaaugggcgcucccauguuauucagguagagaugucaacaauguacaccuagccccugcuguagcccccaguuuuccgggugaacaacuucucuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguagggucuuguuugagugcaaacuccauaaaucaggcuaugucacaguggcucauaccggccaacauaauuuggucaucccccccaaugguuauuuuagguuugauuccuggguuaaucaguucuacacacuugcccccaugggaaauggaacggggcguagacguguuuaa

SEQ ID NO: 7560 - RNA, 1617 nt, Artificial Sequence
  VP1__Norovirus_and/or_Norovirus-like__KR904212
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccacuuggccagaauguacaaugguuaugcaggugguuuugaagugcagguaauccucgcggggaacgcguucaccgccgggaaaaucacauuugcagcagucccaccaaauuucccaacugaagguuugagccccagccaggucacuauguucccccacauaauaguagauguuaggcaauuagaaccuguguugauccccuuacccgauguuaggaauaauuucuaucacuauaaucaaucaaaugaccccaccaucaaauugauagcaauguuguauacaccacuuagggcuaauaaugcuggggacgaugucuucacaguuucuugucgaguucucacgaggccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggccccaguaguaccuuuguuguucaaccacaaaacggcaggugcacgacugauggcgugcuccuggguacuacccaacugucuccugucaacaucugcaccuucagaggggaugucacccauauuacaggcagucauaacuacacaaugaaccuggcuucccaaaauuggagcaguuaugacccaacagaagaaaucccagccccucuaggaaccccagauuucguggggaagauccaaggugugcucacccaaaccacaaggacagauggcucgacccgcggccacaaagcuacaguguucacugggagcgcugacuuuucuccaaaacuggguagaguucaauuugccacugacacagacaaugauuuuguugcuaaccaaaacacaaaguucaccccagucgguguuauccaggauggugguacugcccaccgaaaugaaccccaacaaugggugcucccaaguuacucaggcagaaauauucacaauguacaccuggcccccgcuguagcccccacuuuuccgggugagcaacuccucuucuucagauccaccaugcccggaugcagcggguaccccaacauggauuuggacugucugcucccccaggaaugggugcaguauuucuaccaggaagcagccccagcacaaucugauguggcucugcuaagauuugugaauccagacacagguaggguuuuguuugaguguaagcuucauaaaucaggcuauguuacaguggcucacacuggccaacaugauuugguuaucccccccaacgguuauuuuagguuugacuccugggucaaccaguucuacacacuugcccccaugggaaaugggacggggcgcagacgauaa

SEQ ID NO: 7561 - RNA, 1617 nt, Artificial Sequence
  VP1__Norovirus_and/or_Norovirus-like__AB933678
augaagauggcgucuaaugacgccaacccauuugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucacugccggaaaaauuauauuugcagcagucccaccaaauuuuccagcugaaggcuugagucccagccaggucacuauguucccccacauaauaguggauguuaggcaauuggaaccuguguugauccccuuaccugauguuaggaauaacuucuaucauuauaaccagucaaaugauucuaccauuaaauugauagcaauguuguauacaccacuuagggcuaauaaugcuggggaagaugucuuuacagucucuugucgaguucucacgaggccauccccugauuuugauuuuauauucuuggugccaccuacaguugagucaagaacuaaaccauuuacugucccaaucuuaacuguugaagaaaugaccaauucaagauuccccauuccuuuggaaaaacuguucacgggucccagcagugccuuuguuguucaaccacaaaauggcagaugcacgacugauggcgugcucuuaggcaccacccaacuguccccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagccacaguuuacacugggagugcccccuuuacuccaaagcugggcaguguccaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccaggugagcaacuucuuuucuuuagguccacuaugcccggaugcagcggguaucccaacauggauuuggauugccugcucccccaggaguggguacagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaauggcuauuuuagguuugauuccuggguuaaucaguucuacacacuugcccccaugggaaauggaacggggcguagacguuaa

SEQ ID NO: 7562 - RNA, 1617 nt, Artificial Sequence
  VP1__Norovirus_and/or_Norovirus-like__AB933648
augaagauggcgucgaaugacgccaacccaucugauggguccgcagccaaccucgucccagaggucagcaacgagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaauaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcuggguaguguucaauucaguacugauacagaaaaugauuuugaaacucaccaaaacacaaaauucaccccagucggugucauccaggaugguagcaccacccaccgaaaugaaccccaacaaugggugcucccaaguuacucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacucgcccccaugggaaauggaacggggcguagacguuaa

SEQ ID NO: 7563 - RNA, 1617 nt, Artificial Sequence
  VP1__Norovirus_and/or_Norovirus-like__LN854571
augaagauggcgucgaaugacgccgcuccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaucugaaucccuaccuuucucauuuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccacuaucaaauugauagcaaugcuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaauuguucacgggccccaguagugccuuuguuguucaaccacaaaauggcaggugcacgacugauggcgugcuccuagguacuacccaacuguccccugucaacaucugcaccuucagaggggaugucauccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccucaacaaugggugcucccaaguuacucaggcagaaacauucauaaugugcaccuggcccccgcuguagcccccacuuucccgggcgagcagcuccucuucuuuagaucuacuaugcccggaugcagcggguaccccaacauggauuuggacugucugcucccccaggagugggugcaguacuucuaccaggaggcagccccagcacaaucugauguggcucuguugagauuugugaauccagacacagguaggguuuuguuugaguguaagcuccauaaaucaggcuauguuacaguggcucacacuggucaacaugauuugguuaucccccccaaugguuauuuuagauuugauuccugggucaaccaguucuacacacuugcccccaugggaaaugggacggggcguagacguuaa

SEQ ID NO: 7564 - RNA, 1617 nt, Artificial Sequence
  VP1__Norovirus_and/or_Norovirus-like__EU921384
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauagaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaggugcaggugauccucgcggggaacgcguucaccgccggaaaaauuauauuugcagcagucccaccaaauuuuccaacugaaggucugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccuaacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccacaaagcuacaguuuacacugggagugcccccuuuacuccaaaacugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7565 - RNA, 1617 nt, Artificial Sequence
  VP1__Norovirus_and/or_Norovirus-like__LC005716
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauauuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccauuauaaucagucaaaugacucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucugguaauuacacaaugaauuuggcuucuguaaauuggaacaauuaugacccaacagaagaaauuccagccccucuaggaacuccagauuuugugggaaagauccaggguaugcucacccaaacuacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguaacaccacccaccgaaaugaaccccaacaaugggugcucccaaguuauucagguagaaaugucccuaauguacaccuagccccugcuguagcccccacuuucccaggugaacaacuucucuucuuuagguccacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguagcucacaccggccagcaugauuuggucaucccccccaaugguuauuuuagguuugauuccuggguuaaucaauucuacacacuugcccccaugggaaauggaacggggcguagacguuaa

SEQ ID NO: 7566 - RNA, 1617 nt, Artificial Sequence
  VP1__Norovirus_and/or_Norovirus-like__KP241914
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuuggguccugaucuaaaucccuaccuaucccaucuggccagaauguacaaugguuaugcaggugguuuugaagugcagguaauccucgcggggaacgcguucaccgccgggaaggucauauuugcagcagucccaccaaauuuuccaacugaaggcuugagccccagccaggucacuauguucccccauauaguaguagacguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacaggcagucgaaacuacacaaugaauuuggcuucucaaaauuggaacaauuaugacccaacagaagaaaucccagccccucuagggacuccagauuuuguggggaagauucaaggcgugcucacccaaaccacaaggacagauggcucaacacgcggccacaaagcuacaguguacacugggagcgcugauuuuucuccaaaacuggguagaguucaauuugaaacugauacagaccgugauuuugaagcuaaccaaaacacaaaguucaccccaguuggugucauccaagaugguggcaccacccaccgaaaugaaccccaacagugggugcucccaaguuacucaggcagaaaugcuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuauaccccccaaugguuauuuuagguuugauuccugggucaaccaguuuuacacgcuugcccccaugggaaauggaacggggcguaggcguuaa

SEQ ID NO: 7567 - RNA, 1617 nt, Artificial Sequence
  VP1__Norovirus_and/or_Norovirus-like__KJ433968
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcucccaggcaccacccaacugucuccugucaacaucugcaccuucagaggagaugucacccauaucacggguagucguaacuacacaaugaauuuggcuucucaaaauuggaacaauuaugacccaacagaagaaaucccagccccucuaggaacuccagauuuuguggggaagauucaaggcgugcucacccaaaccacaaggucagauggcucaacacguggccacaaagcuacaguguacacugggagcgccgauuuugcuccaaaacuggguagaguccaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggccccugcuguagcccccacuuucccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7568 - RNA, 1617 nt, Artificial Sequence
  VP1__Norovirus_and/or_Norovirus-like__KP176409
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucacuacaaucaaucaaaugaucccaccauuaaguugauagcaauguuguauacaccacuuagggcuaacaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguauacugggagcgcugacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7569 - RNA, 1617 nt, Artificial Sequence
  VP1__Norovirus_and/or_Norovirus-like__KM514064
augaagauggcgucgagugacgccaacccaucugauggguccgcagccaaccucguuccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaccaaucaagugaucccaccauuaaguugauagcaauguuguauacaccacuuagggcuaacaaugcuggggaugaugucuucacaguuuccugccgaguucuuacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucagggcgugcucacccaaaccacaaggacagauggcucaacacgcggccacaaagccacaguguacacugggagcgccgacuuugcuccaaaacuggguagaguucaauuugaaacugacacaaaccaugauuuugaagcuaaccaaaacacaaaguucaccccaguuggugucauccaagaugguagcaccacccaccgaaaugaaccccaacagugggugcucccaaguuacucaggcagaaauacucccaaugugcaucuggcccccgcuguagcccccacuuuuccgggugagcaacuucucuucuucagauccaccaugcccggaugcagcggauaccccaacauggauuuggacugccugcuuccccaggaaugggugcaguacuucuaccaagaggcggccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7570 - RNA, 1617 nt, Artificial Sequence
  VP1__Norovirus_and/or_Norovirus-like__KJ649703
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguuuccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggaugaugucuuuacaguuucuugccgaguucucacgagaccaucccccgauuuugauuuuauauuucuagugccacccacaguugagucaaggacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuauacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuuucuccaaaacuggguagaauucaauuugaaacugacacaaaccaugauuuugaagcuaaccaaaacacaaaguucaccccaguuggugucauccaagaugguggcaccacccaccgaaaugaaccccaacagugggugcucccaaguuacucgggcagaaauacuccuaaugugcaucuggcccccgcuguggcccccacuuuuccgggugagcaacuucucuuuuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaucaguuuuacacgcuugcccccaugggaaauggaacggggcguagacguuaa

SEQ ID NO: 7571 - RNA, 1617 nt, Artificial Sequence
  VP1__Norovirus_and/or_Norovirus-like__KF177447
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuguggagcgcgcccuugggcccugaucuaaaucccuaccuaucccauuuggccagaauguacaauggcuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcagcuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacauaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugauacagaccaugauuuugaagcuaaccaaaacacaaaguucaccccaguuggugucauccaagaugguagcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7572 - RNA, 1617 nt, Artificial Sequence
  VP1__Norovirus_and/or_Norovirus-like__JX439820
augaaaauggcgucgaaugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccgaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagccauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuucaagcagucguaacuacacaaugaauuuggccucccaaaauuggagcaguuacgauccaacagaagaaaucccagccccucuaggaacuccagauuucguggggaagauucaagguguacucacccaaaccacaaggacagauggcucgacccgcggccacaaagcuacaguguacacugggagcgccgacuuuucuccaaaacuggguagaguucaauuugacacugacacagacaaugauuuugaaacuaaccaaaacacaaaguucaccccagucgguguuauccaggaugguaguacuaccuaccgaaaugaaccccaacaaugggugcucccaaguuacucaggcagaaacacucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaacccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacguuaa

SEQ ID NO: 7573 - RNA, 1617 nt, Artificial Sequence
  VP1__Norovirus_and/or_Norovirus-like__HF952120
augaagauggcgucgagugacgccaacccaucugauggguccacagccaaccucgucccagaggucaacaaugagguuauggcuuuggagcccguuguuggugccgccauugcggcaccuguggcgggccaacaaaauauaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccauauaauaguagauguuagacaacuggagcccgugcugguccccuuacccgauguuaggaauaauuucuaccauuacaaucaaucaaaugaccccacuaucaaacugauagcaauguuguauacaccacuuagggcuaauaaugcuggggacgaugucuucacaguuucuugucgaguucucacgagaccaucccccgauuuugauuucauauuuuuagugccacccacaguugaaucaagaaccaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacccaauugucuccugucaacaucugcacauucagaggggaugucacccauauugcaggcagucguaacuauacaaugaaucuggcuucccaaaauuggaacaguuaugacccaacagaagaaaucccagccccucuaggaacuccagacuucgugggaaagauucaaggugugcucacccaaaccacgaggacagauggcucgacccgcggccacaaagcuacaguguacacugggagcgccgacuuuucuccaaaacuggguagaguucaauuugccacugacacagacaaugauuucgaggcuaaccaaaacacaaaguucaccccagucggugucauccaggaugguaguacugcccaccgaaaugaaccccaacaaugggugcucccaaguuacucaggcagaaauauucauaaugugcaccuggcccccgcuguagcccccacuuuuccgggugagcaacuccucuucuucagaucuaccaugcccggaugcagcggguaccccaacauggauuuggacugucugcucccccaggaaugggugcaauauuucuaccaggaagcagccccagcacaaucugauguggcucugcuaagauuugugaauccagacacagguaggguuuuguuugaguguaagcuucauaagccaggcuauguuacaguggcucacacuggccaacaugauuugguuaucccccccaauggcuauuuuagauuugauuccugggucaaccaguucuacacacuugcccccaugggaaacgggacggggcguagacgcuaa

SEQ ID NO: 7574 - RNA, 1617 nt, Artificial Sequence
  VP1__Norovirus_and/or_Norovirus-like__KC517369
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcaacagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugacuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccuguuaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcgcuauugagauuugugaauccagacacggguaggguccuguuugagugcaaacuucauaaaucaggcuaugucacaguggcccacaccggucagcaugauuuggucaucccccccaaugguuauuuuagguuugauuccuggguuaaccaauucuacacgcuugcccccaugggaaacggaacggggcguagacguuaa

SEQ ID NO: 7575 - RNA, 1617 nt, Artificial Sequence
  VP1__Norovirus_and/or_Norovirus-like__KC409293
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaauguuguacacaccacuuagggccaauaacgcuggggaagaugucuucacagucucuugucgaguccuuacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucaaaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7576 - RNA, 1617 nt, Artificial Sequence
  VP1__Norovirus_and/or_Norovirus-like__JX984951
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucaaucaaaugauucuaccauuaaguugauagcaaugcuguauacaccacuuagggcuaauaaugcuggggaagaugucuucacagucucuugucgaguccucacgaggccauccccugauuuugauuucauauuuuuggugccaccuacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagcuccucuaggaacuccagauuucgugggaaagauccaaggugugcucacucaaaccacuaagggggaugguucgacccguggccauaaagcuacaguuuacacugggagugcccccuuuacuccaaagcugggcaguguucgauucaguacugauacagaaaaugauuuugaaacucaccaaaacacaaaauucaccccagucggugucauccaggaugguggcaccacccaccgaaaugaaccccaacaaugggugcucccaaauuauucagguagugaugucccuaauguacaccuagccccugcuguagcccccaauuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugaauguaaacuccauaaaucaggcuaugucacaguggcucacaccggccagcaugauuuggucaucccccccaaugguuauuuuagguuugauuccuggguuaaucaauucuacacacuugcccccaugggaaauggaacggggcgcagacguuaa

SEQ ID NO: 7577 - RNA, 1617 nt, Artificial Sequence
  VP1__Norovirus_and/or_Norovirus-like__JX459612
augaagauggcgucgagugacgcccacccaucugauggguccacagccaaccucgucccagaggucaacaaugaggucauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguauugaucccuuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguccaaccacaaaauggcaggugcacgacugauggcgugcucuuagguacuacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucguggguaagauccaaggcgugcucacccaaaccacaaguagggauggcucgacccgcggucacaaagccacagugagcacuggaaguguccacuucaccccaaagcugggcagaguucaauucuccacugauacaagcaaugauuuugaaacuggccaaaacacgagauucaccccagucgguguuguccaggaugguaguaccacccaucaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauuguuuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuacacacuugcccccaugggaaauggaacggggcguagacguuaa

SEQ ID NO: 7578 - RNA, 1617 nt, Artificial Sequence
  VP1__Norovirus_and/or_Norovirus-like__JX459604
augaagauggcgucgaaugacgucaccccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7579 - RNA, 1617 nt, Artificial Sequence
  VP1__Norovirus_and/or_Norovirus-like__JX155745
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguggauguuaggcaauuggaaccuguguugauccccuuaccugauguuaggaauaauuucuaucacuauaaucagucaaaugauucuacuauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaauucaagauuccccauuccuuuggagaaguuguucacgggucccagcagugccuuuguuguucaaccacaaaauggcagaugcacaacugauggcgugcucuuaggcaccacccagcuguccccugucaacaucugcaccuucagaggggaugucacccacauugcagguucucgaaauuacacaaugaauuuggcuucucuaaauuggaacaauuaugacccaacagaagaaauuccagccccucuaggaacuccagauuucgugggaaagauccaaggugugcucacucaaaccacaaggggagauggcucgacccguggccauaaagccacaguuuacacugggagugcccccuucacuccaaagaugggcaguguccaauucaguacugacacagaaaaugauuuugaaacucaccaaaacacaaaauucaccccagucggugucauccaggaugguggcaccacccaccgaaacgaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacgcuugcccccaugggaaauggaacggggcguagacguuaa

SEQ ID NO: 7580 - RNA, 1617 nt, Artificial Sequence
  VP1__Norovirus_and/or_Norovirus-like__HM635155
augaagauggcgucgagugacaccaaaacaucugauggguccacagccaaccucgucccagaggucaacaaugagguuauggcuuuggagcccguuguuggugccgccauugcggcgccuguagcgggccaacaaaauguaauugaccccuggauuagaaauaauuuuguacaagccccugguggagaguucacaguauccccuaggaacgcuccaggugaaauacuguggagcgcgccccuaggcccugauuugaauccuuaccuuucccauuuggccagaauguacaacggcuaugccggcgguuuugaagugcagguaauccucgcggggaacgcguucaccgccggaaaaaucauauuugcagcagucccaccaaauuucccaacugaaggcuugagccccagccagguuacuauguucccccacauaauaguagauguuaggcaacuggaaccuguguugauccccuuacccgauguuaggaauaauuucuaucacuacaaucaaucaaaugaccccaccaucaaauugauagcaauguuguacacaccacuuagggcuaauaaugcuggggacgaugucuuuacaguuucuugucggguacucacgagaccaucccccgauuuugauuucauauuuuuagugccacccacaguugaaucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgauugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucgugggaaagauccaaggugugcucacccaaaccacgagggcagauggcucgacccguggacacaaagcuacaguguacacugggagcgccgacuuugcuccaaaacuggguagaguucaauuugccacugacacagacaaugauuuugaugcuaaccaaaacacaaaguucaccccagucggugucauccaggaugguaauacugcccaccgaaaugaaccccaacaaugggugcucccaaguuacucagguagaaauagucacaacgugcaccuggcccccgcuguagcccccacuuuuccgggugagcaacuucucuucuucagaucuacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugaucugguuaucccccccaaugguuauuuuagauuugauuccugggucaaccaguucuacacacuugcccccaugggaaauggaacggggcguagacguuaa

SEQ ID NO: 7581 - RNA, 1617 nt, Artificial Sequence
  VP1__Norovirus_and/or_Norovirus-like__JN400620
augaagauggcgucgaaugacgucaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucuaaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaagguuugagucccagccaggucacuauguucccccacauaauaguggauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaagaugucuucacagucucuugucgaguccucacgaggccauccccugauuuugauuucauauuuuuggugccacccacaguugagucaagaacuaaaccauuuacugucccaaucuugacuguugaggaaaugaccaauucaagauuccccauuccuuuggaaaaguuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagagaugucccuaauguacaccuagccccugcuguagcccccacuuucccgggugaacaacuucuuuucuuuaggucuacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaacgguuauuuuagguuugauuccuggguuaaucaauucuacacacuugcccccaugggaaauggaacggggcguagacguuaa

SEQ ID NO: 7582 - RNA, 1617 nt, Artificial Sequence
  VP1__Norovirus_and/or_Norovirus-like__JQ613573
augaagauggcgucgagugacgccaauccaucugauggguccacagccaaccucgucccagaggucaacaaugagguuauggcucuggagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaccccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccauauaauaguagauguuaggcaauuggaaccuguguugauucccuuacccgauguuaggaauaauuucuaccacuauaaucaaucaaaugaccccaccaucaaacugauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguuuacgggccccaguagugccuuuguuguucaaccacaaaacggcaggugcacgacugauggcgugcuccuagguacuacccaacuguccccugucaacaucugcaccuucagaggggaugucacccauauuccaagcagucguaacuacacaaugaauuuggccucccaaaauuggaacaguuacgauccaacagaagagaucccagccccucuaggaacuccagauuucguggggaagauucaaggugugcucacccaaacaacaaggacagauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguacuacccaccgaaaugaaccccaacaaugggugcucccaaguuacucaggcagaaacauucauaaugugcaccuggcccccgcuguggcccccacuuucccgggcgagcagcuucucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguaggcguuaa

SEQ ID NO: 7583 - RNA, 1617 nt, Artificial Sequence
  VP1__Norovirus_and/or_Norovirus-like__JQ478408
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuugugcaagccccugguggagaauuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuacccgauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauucuaacuguugaggaaaugaccaauucaagauucccuauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccauaaagcuacagugagcacuggggauguccacuucacuccaaagcugggcaguauucaguucaacacugauacaaacaaugauuuugaaacuggccaaaacacgaaauucaccccagucgguguuguccaggaugguaauggugcccaccaaaaugaaccucaacaaugggugcucccaagcuacucagguagaacuggucauaauguacaccuagcccccgccguagcccccacuuuuccgggugagcaacuucuuuucuuuagguccacuaugcccggaugcagcggguaccccaacaugaauuuggauugucuacucccccaggaaugggugcagcacuucuaccaagaggcagcuccagcacaaucugauguggcucugcuaagauuugugaauccagacacaggucggguucuauuugagugcaagcuucauaaaucaggcuaugucacaguggcucacacuggccaacaugauuugguuaucccccccaauggcuacuuuagauuugauuccugggucaaccaauucuacacacuugcccccaugggaaaugggacggggcguagacguuaa

SEQ ID NO: 7584 - RNA, 1617 nt, Artificial Sequence
  VP1__Norovirus_and/or_Norovirus-like__EF684915
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaaccaaaccauuuacugucccaaucuuaacuguugaagaaaugaccaauucaagauuccccauuccuuuggaaaaguuauucacgggucccagcggugccuuuguuguucaaccacaaaauggcagaugcacgacugauggcgugcucuuaggcacuacccaacugucuccugucaacaucugcaccuucagaggggaugucacccacauugcagguucucguaauuacacaaugaauuuggcuucucuaaaauggaacaaauaugacccaacagaagaaauuccagccccucuaggaacuccagauuucgugggaaagauccaaggugugcucacucaaaccacaaagggagauggcucgacccguggccauaaagcuacaauuuacacugggagugcccccuuuaccccaaagcugggcaguguucaauucaguacugauacagaaaaugauuuugaaacucaccaaaacacaaaauucaccccagucgguguuacccaggaugguagcaccacccaccgaaaugaaccccaacaaugggugcucccaaguuacucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 7585 - RNA, 1617 nt, Artificial Sequence
  VP1__Norovirus_and/or_Norovirus-like__HQ456331
augaagauggcgucgaaugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggggaguucacaguguccccuagaaacgcuccaggugaaauacuauggagcgcgcccuuaggcccugaucugaaucccuaccuaucucauuuggccagaauguauaacgguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaacuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7586 - RNA, 1617 nt, Artificial Sequence
  VP1__Norovirus_and/or_Norovirus-like__HQ456322
augaagauagcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguauaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuacaaucaaucaaacgaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagcgccuuuguuguucaaccacaaaauggcaggugcacgacugauggcgugcucuuagguacuacccaacugucuccugucaacaucugcaccuucagaggggaugucacccacauugcuaguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccguggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugacguggcucugcuaagauuugugaauccagacacagguaggguuuuguuugaguguaagcuucauaaaucaggcuaugucacaguggcucacacuggccaacaugauuuaguuaucccccccaauggcuauuuuagauuugauuccugggucaaccaguucuacacacuugcccccaugggaaaugggacggggcguagacguuaa

SEQ ID NO: 7587 - RNA, 1617 nt, Artificial Sequence
  VP1__Norovirus_and/or_Norovirus-like__HM802551
augaagauggcgucgaaugacgccagcccaucugauggguccacagccaaccucgucccagaggucaacaaugagguuauggcuuuggagcccguuguuggugccgcuauugcggcaccuguggcgggccaacaaaauguaauugaccccuggauuaggaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuauaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcaccacccaacugucccccgucaacaucugcaccuucagaggcgaugucacccacauuucagguucucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggucaaaacacaagguucaccccaguuggugucauccaggaugguaguaguacccacagaaaugaaccccaacaauggguacuuccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaacccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacguuaa

SEQ ID NO: 7588 - RNA, 1617 nt, Artificial Sequence
  VP1__Norovirus_and/or_Norovirus-like__HM802546
augaagauggcgucgaaugacgccagcccaucugauggguccacagccaaucucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaucauuacaaucaaucaaaugacuccaccauuaaauugauagcaaugcuguacacaccacuuagggcuaauaaugcuggggaugacgucuucacagucucuugucgaguccucacgaggccaucccccgauuuugauuucauauuucuggugccacccacaguugagucaagaaccaaaccauucaccgucccaaucuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuucaggcacucguacuuacaggaugaauuuggcuucucaaaauuggaacaauuaugacccaacagaagaaaucccagccccucugggaaccccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuugcugagauuugugaauccagacacagguaggguucuguuugagugcaagcuucauaaagcaggcuaugucacaguggcucauacuggccagcaugauuugguuaucccccccaaugguuacuuuagauuugauuccugggucaaccaguucuacacacuugcccccaugggaaauggagcggggcguagacguuaa

SEQ ID NO: 7589 - RNA, 1617 nt, Artificial Sequence
  VP1__Norovirus_and/or_Norovirus-like__GQ856453
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggcgauccucgcggggaacgcguucaccgccggaaaaauuauauuugcagcagucccaccaaauuuuccaacugaaggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacgaagggagauggcucgacccguggccauaaagcuacaguuuacacugggagugcccccuuuacuccaaagcugggcagucuucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7590 - RNA, 1617 nt, Artificial Sequence
  VP1__Norovirus_and/or_Norovirus-like__GQ856445
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaguggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugagcaacuucuuuucuuuagguccacuaugcccggaugcagcggguaucccaacguggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7591 - RNA, 1617 nt, Artificial Sequence
  VP1__Norovirus_and/or_Norovirus-like__AB541358
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcugucccaccaaauuuuccaacugaaggcuugagucccagccaggucacuauguucccccacauaauaguggauguuaggcaauuggaaccuguguugauccccuuaccugacguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacuguccucaucuuaacuguugaagaaaugaccaauucaagauuccccauuccuuuggaaaaacuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaauucaccaaaacacaaaauucaccccagucggugucauccaggaugguagcaccacccaccgaaaugaaccccaacaaugggugcucccaaguuauucagguagaaauguccauaauguacaccuagccccugcuguggcucccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcuuacaccggccagcaugauuuggucaucccccccaaugguuauuuuagguuugauuccuggguuaaucaauucuacacacuugcccccaugggaaauggaacggggcguagacguuaa

SEQ ID NO: 7592 - RNA, 1617 nt, Artificial Sequence
  VP1__Norovirus_and/or_Norovirus-like__AB541349
augaagauggcgucgaaugacgccaacccaucugauggguccgcagccaaccucgucccagaggucaacaaugagguuauggcuuuggagcccguugucggugcugcuauugcggcgccuguagcgggccaacaaaauguaauugaccccuggauuagaaauaauuuuguacaagccccugguggagaguucacaguauccccuaggaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggagcccguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauucccuauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaauaauuaugacccaacagaagaaauuccagccccucuaggaacuccagauuucgugggaaagauccaaggugugcucacucaaaccacaaagggagauggcucgacccguggccauaaagcuacaguuuacacugggaguacccccuuuacuccaaagcugggcaguguucaauucaguacugauacagaaaaugauuuugaaacucaccaaaacacaaaauuuaccccagucggugucauccaggaugguagcaccauccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguauccuaacauggauuuggauugccuacucccccaggagugggugcagcacuucuaccaagaggcagcuccagcacaaucugauguggcucuacugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuauacacuugcccccaugggaaauggaacggggcguagacguuaa

SEQ ID NO: 7593 - RNA, 1617 nt, Artificial Sequence
  VP1__Norovirus_and/or_Norovirus-like__AB541342
augaagauggcgucgaaugacgccaacccaucugauggguccgcagccaaccucgucccagaggucaacaaugagguuauggcuuuggagcccguugucggugccgcuauugcggcgccuguagcgggccaaacaaauguaauugaccccuggauuagaaauaauuuuguacaagccccugguggagaguucacaguauccccuagaaacgcuccaggugaaauacuauggagcgcgccuucaggcccugaucugaaucccuaccuaucucauuuggccagaauguuuaaugauuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggaacccguguugauccccuuaccugauguuaggaauaacuucuaucauuauaaucagucaaaugauucuaccauuaaacugauagcaaugcuguauacaccacuuagggccaauaaugcuggggaagaugucuucacagucucuugucggguccucacgaggccguccccugauuuugauuuuauauuuuuggugccacccacaguugagucaagaacuaaaccauuuacugucccaauuuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaaggugugcucacucaaaccacaaagggagauggcucgacccguggucauaaagcuacaguuuacacugggagugcccccuuuacuccaaagcugggcaguguucaauucaguacugauacagaaaaugauuuugaagcucaccaaaacacaaaauucaccccagucggugucauccaggaugguagcaccacccaccgaaaugaaccccaacaaugggugcucccaaguuauucagguagaaauguucaaaauguacaccuagccccugcuguagcccccacuuuuccgggugaacaacuccuuuucuucagguccacuaugcccggaugcagcggguaucccaacauggauuuggauugccuacucccccaggagugggugcagcacuucuaccaagaggcagcuccagcacaaucugauguggcuuuauugagauuugugaauccagacacggguaggguccuguuugagugcaaacuucauaaaucaggcuaugucacaguggcccacaccggccagcaugauuuggucaucccccccaauggcuauuuuagguuugauuccuggguuaaucaauucuacacacuugcccccaugggaaauggaacggggcguagacguuaa

SEQ ID NO: 7594 - RNA, 1617 nt, Artificial Sequence
  VP1__Norovirus_and/or_Norovirus-like__AB541248
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcacccuuaggcccugaucugaaucccuaccuaucucauuuggccagaauguauaauaguuaugcaggugguuuugaagugcaggugauccucgcggggaacgcguucaccgccgguaaaaucauauuugcagcagucccaccaaauuuuccaacugaaggcuugagucccagccaggucacuauguucccccacauaauaguggauguuaggcaauuggaaccuguguugauccccuuaccugauguuaggaauaacuucuaccacuauaaucagucaaaugauucuaccauuaaguugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucgguguuauccaggaugguggcaccacccaccgaaaugaaccccaacaaugggugcucccaaguuauucagguagagauguccauaauguacaccuagccccugcuguagcccccacuuuuccgggugaacaacuucuuuucuuuagauccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7595 - RNA, 1617 nt, Artificial Sequence
  VP1__Norovirus_and/or_Norovirus-like__GQ246798
augaagauggcgucgagugacgccaacccauuugauggguccacagccaaccucgucccagaggucaacaaugagguuauggcuuuggaacccguuguuggugccgccauugcggcaccuguggcgggccaacaaaauguaauugaccccuggauuagaaacaauuuuguacaagccccugguggagaguucacaguauccccuagaaacgcuccaggugaaauacuauggagcgcgcccuuaggcccugauuugaaccccuaucuuucccauuuggcuagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaacuggaaccuguguugaucccccuacccgauguuaggaauaauuucuaucacuacaaucaaucaaaugaccccaccaucaaacugauagcaauguuauauacaccacuuagggcuaauaaugcuggagacgacgucuucacaguuucuugucggguucucacgaggccaucccccgauuuugauuucauauuuuuagugccacccacaguugagucaagaacuaaaccauucucugucccaaucuuaacuguugaggagaugaccaauucaagauuccccauuccuuuggaaaaguuguuuacgggucccagcagugccuuuguuguucaaccacaaaacggcaggugcacgacugauggcgugcuccuagguaccacccaacugucuccugucaacaucugcaccuucagaggggaugucacccauaucacagguagucguaacuacacaaugaauuuggcuacucaaaauuggaacaguuaugacccaacagaagaaaucccagccccccuaggaacuccagauuucguggggaagauucaaggugugcucacccaaaccacaagggcagauggcucgacucgcggccacaaagcuacaguguacacugggagcgccgacuuugcuccaaaacuggguagaguucaauuugccacugacacagacaaugauuuugaugcuaaccaaaacacaaaguucaccccagucggugucauccaggaugguaauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccucaggaaugggugcaguauuucuaucaagaggcagccccagcacaaucugauguggcucugcuaagauuuguaaauccagacacagguaggguuuuguuugaguguaaacuucauaaaucaggcuauguuacaguggcucacaccggccaacaugauuugguuaucccccccaaugguuauuucagauuugauuccugggucaaccaguucuacacacuugcccccaugggaaauggaacggggcguagacguuaa

SEQ ID NO: 7596 - RNA, 1617 nt, Artificial Sequence
  VP1__Norovirus_and/or_Norovirus-like__GQ246791
augaagauggcgucgaaugacgccaacccaucugauggguccacagccaaccucgucccagaggucaacaaugaggucauggcuuuggagcccguugugggugccgcuauugcggcaccuguagcgggccaacaaaauguaauugaccccuggauuagaaauaauuuuguacaagccccugguggagaguucacaguguccccuagaaaugcuccaggugagauauuauggagcgcacccuuagguccugauuugaauccuuaccuuucccauuuggccagaauguacaaugguuaugcaggugguuuugaagugcagguaauccuugcggggaacgcguucaccgccggaaaaaucauauuugcagcagucccaccgaacuuuccaacugaaggccuuagucccagucagguuacuauguucccccguauaauaguagauguuaggcaauuggaaccuguguugauccccuuaccugauguuaggaacaauuucuaucacuacaaccaaucaaaugaccccaccauuaaguugauagcaaugcuguauacaccacucagggcuaauaaugcuggggaugaugucuucacagucucuugucgaguccuuacgaggccauccccugauuuugauuucauauuucuggugccaccaacaguugaaucaagaacuaaaccauucacugucccaaucuuaacuguugaggaaaugaccaauucaagauuccccaucccuuuggaaagguuguacacgggucccagcagugcuuuuguuguccagccacaaaacggcagaugcacgacugauggcgugcucuuaggcaccacccagcugucugcuguuaacaucugcaccuuuagaggagaugucacccacauugcaggcucucgcaauuacacaaugaaucuggccucucaaaauuggaacaacuaugacccaacagaagaaaucccagccccccugggaaccccagacuucgugggaaagauccaaggcaugcucacccaaaccacaagaagugauggcuccacccguggccacaaagccacagugcucacugggagugccgacuuugccccaaaacugggcagaguccaauucgccacugacacggacaaugauuuugaauccggccaaaauacgaaauucaccccagucggcgucauccaggaugguuccacaacccaccgaaaugaaccccaacaauggguacucccaaauuacucagguagaacuggucacaauguacaccuagccccugccguugcccccacuuacccgggugagcaacuccuuuucuucagguccacuaugcccggguguagcggguaucccaacauggaucuagacugcuugaucccccaggauugggugcaacacuucuaccaggaagcagccccagcacaaucugauguggcucugcuaagguuugugaauccagacacagguaggguuuuguuugagugcaagcuccauaaaucaggauaugucacaguggcucauacuggucagcaugauuuaguuauuccccccaaugguuauuuuagauuugauucuugggucaaccaguuuuacacacuugcccccaugggaaaugggacggggcguagacguuaa

SEQ ID NO: 7597 - RNA, 1617 nt, Artificial Sequence
  VP1__Norovirus_and/or_Norovirus-like__GU350225
augaagauggcguccaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaaugcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccagguacucguacuuacagaaugaauuuggcuucucaaaauuggaacaauuaugacccaacagaagagaucccagccccucugggaacuccagauuucgugggaaagauccaaggcaugcucacccaaaccacaaagggagacggcucgacccgcggucacaaagcuacagugagcacugggaguguugacuucacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacugcucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuuguaaauccagacacagguaggguucuguuugagugcaagcuacauaaagcaggcuaugucacaguggcucacacuggccagcaugauuugguuaucccccccaauggcuacuuuagauuugauuccugggucaaccaguucuacacacuugcccccaugggaaauggagcggggcgcagacguuaa

SEQ ID NO: 7598 - RNA, 1617 nt, Artificial Sequence
  VP1__Norovirus_and/or_Norovirus-like__AB504319
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaggccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaagugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcucacucaaaccacaaagggggauggcucgacccguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7599 - RNA, 1617 nt, Artificial Sequence
  VP1__Norovirus_and/or_Norovirus-like__AB447458
augaagauggcgucgagugacgccaacccaucugauggguccacagccaaccucgucccagaggucaacaaugagguuauggcuuuggagcccguuguuggugccgcuauugcggcaccuguagcgggccaacaaaacguaauugaccccuggauuagaaauaauuuuguacaagccccugguggagaguuuacaguauccccuagaaacgcuccaggugaaauacuauggagcgcgcccuugggcccugauuugaauccuuaccuuucccauuuggccagaauguacaauaguuaugcaggugguuuugaagugcagguaauccucgcggggaacgcguucaccgccggaaagaucauauuugcagcagucccaccaaauuucccaacugaaggcuugagccccagccaggucacuauguucccccauauaauaguagauguuaggcaacuggaaccuguguugaucccuuugcccgauguuaggaauaauuucuaucacuacaaucaaucaaaugaccccaccaucaaauugauagcaauguuguacacaccacuuagggcuaauaaugcuggggacgaugucuucacaguuucuugucggguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguuuacgggucccagcagugccuuuguuguucaaccacagaauggcaggugcacgacugauggcgugcucuuaggcaccacccaacugucuccugucaacaucugcaccuucagaggggaugucacccacauugcugguacucaagaauacacaaugaaucuggccucccaaaacuggaacaauuaugacccaacagaagaaaucccagccccucugggaacuccagauuucgugggcaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggauggugguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuacacacuugcccccaugggaaauggaacggggcguagacguuaa

SEQ ID NO: 7600 - RNA, 1617 nt, Artificial Sequence
  VP1__Norovirus_and/or_Norovirus-like__AB385640
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuguccagaauguacaauaguuaugcaggugguuuugaagugcagguaauccucgcggggaacgcguucaccgccggaaaaaucauauuugcagcagucccaccaaauuucccaauugaaggcuugagccccagccaggucacuauguucccccauauaauaguagauguuaggcaacuggaaccuguguugaucccuuuacccgauguuaggaauaauuucuaucauuacaaucaaucgaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccacuccuguggaaaaguuguucacgggucccaguagugccuuuauuguucaaccacaaaauggcaggugcacgauugauggcgugcucuuagguacuacccaacugucuccugucaacaucugcaccuucagaggggaugucacccacauugcugguacucaagaauacacaaugaaccuggccucccaaaacuggaacaauuaugacccaacagaagaaaucccagccccucugggaacuccagauuucguggguaagauccaaggcgugcucacccaaaccacaagaagggauggcucgacccgcggucacaaagccacagugagcacuggaaguguccacuucaccccaaagcugggcagaauucaauucuccacugauacaagcaaugauuuugaaacucgucaaaacacgagauucaccccagucgguguuauccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguuauguuugaguguaagcuccauaaaucaggcuauaucacaguggcucacacuggccaacaugauuuaguuaucccccccaauggcuauuuuagauuugaugccugggucaaccaguucuacacacuugcccccaugggaaauggaacggggcguagacguuaa

SEQ ID NO: 7601 - RNA, 1617 nt, Artificial Sequence
  VP1__Norovirus_and/or_Norovirus-like__AB385633
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgccccugggcccugauuugaaucccuaccuuucccauuuggccagaauguacaaugguuaugcaggugguuuugaagugcagguaauccucgcggggaacgcguucaccgccggaaaaaucguauuugcagcagucccaccaaauuucccaacugaaggcuugagccccagccaggucacuauguucccccauauaauaguagaugucaggcaacuggaaccuguguugaucccuuuacccgauguuaggaauaauuucuaucacuacaaucaaucaaaugacuccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuauuguucaaccacaaaauggcaggugcacgacugauggcgugcucuuagguacuacccaacugucuccugucaacaucuguaccuucagaggggaugucacccacauugcugguacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccacuucaccccaaagcugggcagaauucaauucuccaccgauacaaguaaugauuuugaaacuggccaaaacacgagauucaccccagucgguguuguccaggaugguaguaccacccaccaaaaugaaccccaacaauggguacucccaaauuauuuagguagagauagccacaaugugcaccuagccccugccguggcccccucuuuuccgggugagcaacuucuuuucuucagguccacuaugcccggaugcagcggguaucccaacaugaauuuggauugucuacucccccaggaaugggugcagcacuucuaccaagaggcagccccagcacaaucugauguggcucugcuaagauuugugaauccagacacagguaggguucuguuugaguguaagcuucacaaaucaggcuaugucacaguggcucacacuggccaacaugauuuaguuaucccccccaauggcuauuuuagauuugauuccugggucaaccaguucuacacacuugcccccaugggaaauggaacggggcguagacguuaa

SEQ ID NO: 7602 - RNA, 1617 nt, Artificial Sequence
  VP1__Norovirus_and/or_Norovirus-like__DQ658413
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucacuuggccagaauguacaaugguuaugcagguggcuuugaagugcagguaauccuugcggggaaugcguucaccgccgggaaaaucauauuugcagcagucccaccaaauuucccaacugaaggcuugagccccagccaaguuacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuagguacuacccaacugucuccugucaacaucugcaccuucagaggggaugucacccacauugcagacacucauaauuacacaaugaauuuggcuucucaaaauuggaacaauuaugacccaacagaagaaaucccagccccucuggggaccccagauuucgugggaaagauccaaggcaugcucacccaaacuacaaggggggauggcucuacccgcggccacaaagccacagugagcacuggggauguccauuucacuccaaagcugggcaguauucaguucaacacugauacaaacaaugauuuugaaacuggccaaaacacgaaauucaccccagucgguguuguccaggaugguaaugguacccaccagaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcaacacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7603 - RNA, 1617 nt, Artificial Sequence
  VP1__Norovirus_and/or_Norovirus-like__AB220923
augaagauggcgucgaaugacgccagcccaucugauggguccacagccaaccucguuccagaggucaacaaugagguuauggcuuuggagcccguuguuggugccgcuauugcggcaccuguagcgggccaacaaaauguaauugaccccuggauuaggaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuugacuguugaggaaaugaccaauucaagauuccccauuccuuuggaaaaauuguucacgggucccaguagugccuuugucguccaaccacaaaauggcaggugcacgacugauggcgugcucuuaggcacuacccaacugucccccgucaacaucugcaccuucagaggcgaugucacccacauuucagguacccguacuuacagaaugaauuuggcuucucaaaauuggaacaauuaugacccaacagaagagaucccagccccucuggggacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacuguucacaauguacaccuggccccugccguagcccccacuuuuccgggugagcaacuucuuuucuucagaucuacuaugcccggaugcaguggguaucccaauauggauuuggauugucuacucccccaagaaugggugcagcacuucuaccaagaggcagccccaucacaaucugauguggcuuuguugagauuugugaauccagacacagguaggguuuuguuugagugcaagcuucauaaagcaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 7604 - RNA, 1617 nt, Artificial Sequence
  VP1__Norovirus_and/or_Norovirus-like__AY588016
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguaucuccuagaaacgcuccaggugaaauacuauggagcgcgcccuugggcccugaucugaaucccuaccuuucucauuuggccagaauguacaaugguuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuuuauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcaccacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccgcuaugcccggaugcagcggguaccccaacaugaauuuggauugucuacucccccaagaaugggugcagcacuucuaucaagaggcagcuccagcacaaucugauguggcucugcugagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7605 - RNA, 1617 nt, Artificial Sequence
  VP1__Norovirus_and/or_Norovirus-like__AY502022
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacagugucaccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauucgagugcaagcuucauaaaucaggcuaugucacaguggcucacacuggccagcaugauuugguuaucccccccaauggcuacuuuagauuugauucuugggucaaccaauucuacacacuugcccccaugggaaaugggacggggcguagacguuaa

SEQ ID NO: 7606 - RNA, 1617 nt, Artificial Sequence
  VP1__Norovirus_and/or_Norovirus-like__KX158280
augaagauggcgucgagugacgccaacccaucugauggguccgcagccaaccucgucccagaggucaacaaugagguuauggcucuggagcccguuguuggugccgccauugcggcaccuguagcgggccagcaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacgaggacagauggcucaacacguggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7607 - RNA, 1617 nt, Artificial Sequence
  VP1__Norovirus_and/or_Norovirus-like__KX371606
augaagauggcgucgagugacgccaacccaucugauggguccgcagccaaccucgucccagaggucaacaaugagguuauggcucuggagcccguuguuggugccgccaucgcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguuuccccauauaguaguggauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacaggucccagcagugccuuuguuguccaaccacaaaacggcaggugcacgacugauggcgugcuccuaggcaccacccaacugucuccugucaacaucugcacauucagaggagaugucacccauaucacagguagccguaauuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguuuuacacgcuugcccccaugggaaauggaacggggcguagacguuaa

SEQ ID NO: 7608 - RNA, 1617 nt, Artificial Sequence
  VP1__Norovirus_and/or_Norovirus-like__KX371605
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggggaguuuacaguauccccuagaaacgcuccaggugaaauacuauggagcgcgcccuugggcccugaucuaaaccccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaagcacaaaguucaccccaguuggugucauccaagaugguagcaccacccaccgaaaugaaccccaacagugggugcucccaaguuacucaggcagaaauacuccuaaugugcaucuggcccccgcuguagcccccacuuucccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacguuaa

SEQ ID NO: 7609 - RNA, 1617 nt, Artificial Sequence
  VP1__Norovirus_and/or_Norovirus-like__KX354128
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccauuauaaucagucaaaugauucuaccauuaaauugauagcaaugcuguauacgccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagaaaugaccaacucaagguuccccauuccuuuggagaaguuguucacgggucccagcagugccuuuguuguucaaccacaaaauggcagaugcacaacugauggcgugcucuuaggcacuacccagcugucuccugucaacaucugcaccuucagaggggaugucacccacauugcagguucucgcaauuacacaaugaauuuggcuucucuaaauuggaacaauuaugacccaacagaagaaauuccagccccucuaggaacuccagauuucguggguaagauccaagguuuguuaacucaaaccacaaagggagauggcucuacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccggaaugaaccucaacaaugggugcucccaaguuauucggguagaaaugucccuaauguacaccuagccccugcuguagcccccacuuuuccgggugaacaacuccuuuucuuuagguccacuaugcccggaugcagcggguaucccaacauggauuuggacugccugcuaccccaggagugggugcagcacuucuaccaagaggcagcuccagcacaaucugauguggcucuauugagauuugugaauccagacacggguaggguccuuuuugagugcaaacuucauaaaucaggcuaugucacaguggcccacaccggccagcacgauuuggucaucccccccaaugguuauuuuagguuugauuccuggguuaaccaauucuacacgcuugcccccaugggaaacggaacggggcguagacguuaa

SEQ ID NO: 7610 - RNA, 1617 nt, Artificial Sequence
  VP1__Norovirus_and/or_Norovirus-like__KX354099
augaagauggcgucgagugacgccagcccaucugauggguccgcagccagccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaauuaaaugaucccaccauuaaguugauagcaauguuguauacaccacuuagggcuaauaaugcuggggaugaugucuuuacaguuucaugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacagaacggcaggugcacgacugauggcgugcuccuaggcaccacccaacugucuccugucaacaucugcaccuucagaggagaugucacccauaucacagguagucauaacuacacaaugaauuuggcuucucaaaauuggaacaauuaugacccaacagaagaaaucccagccccucuaggaacuccagacuuuguggggaagauucaaggcgugcucacccaaaccacaagggcagauggcucaacacgcggucacaaagccacaguguacacugggagcgccgacuuugcuccaaaacuggguagaguucaauuugaaacugacacagaccaugauuuugaaacuaaccaaaacacaaaguucaccccagucggugucauccaagaugguggcaccacccaccgaaaugaaccccaacagugggugcucccaaguuacucaggcagaaacacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuucagauuugauuccugggucaaccaguucuacacgcuugcccccaugggaaauggagcggggcguagacguuaa

SEQ ID NO: 7611 - RNA, 1617 nt, Artificial Sequence
  VP1__Norovirus_and/or_Norovirus-like__KX354087
augaagauggcgucgaaugacgccaacccaucugauggguccgcagccaaccucgucccagaggucaacaaugagguuauggcuuuggaacccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucacuuggccaggauguauaaugguuaugcaggugguuuugaagugcaagugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucauuauaaucagucaaaugauucuaccauuaaauugauagcaaugcuguacacaccacuuagggccaacaaugccggggaugaugucuucacagucucuugucgaguccucacgaggccauccccugauuuugacuucauauuuuuagugccaccuacaguugagucaagaacuaagcuauuuacugucccaaucuugacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcgggcucucguaauuacacaaugaauuuggccucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaauucaccaaaacacaagauucaccccagucggugucauccaggaugguggcaccacccaccgaaaugaaccccaacaaugggugcucccaagcuauucagguagaaauguccauaauguacaccuagccccugcuguagcccccaauuuuccgggugaacaacuucuuuucuucagguccacuaugccuggaugcagcggguaucccaacauggauuuggauugccuacucccccaggagugggugcaacauuucuaucaagaggcagcuccagcacaaucugauguggcucuauugagauuugugaauccagacacggguaggguccuguuugagugcaaacuucauaaaucaggcuaugucacaguggcucauaccggccaauaugauuuggucaucccccccaauggcuauuuuagguuugauuccuggguuaaucaauucuauacacuugcccccaugggaaauggaacggggcguagacguuaa

SEQ ID NO: 7612 - RNA, 1617 nt, Artificial Sequence
  VP1__Norovirus_and/or_Norovirus-like__KX354009
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaauggcuaugcaggugguuuugaagugcagguaauucucgcggggaacgcguucaccgccgggaagaucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccuguuaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuccucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuaugucacaguggcucacacuggccaacaugauuugguuauuccccccaaugguuauuuuagauuugacuccugggucaaccaguucuacacgcuugcccccaugggaaauggaacggggcguagacguuaa

SEQ ID NO: 7613 - RNA, 1617 nt, Artificial Sequence
  VP1__Norovirus_and/or_Norovirus-like__KR131784
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaaugcguucaccgccgggaaggucauauuugcagcagucccaccaaauuucccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaacgcuggggaugaugucuucacaguuucuugccggguucucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccaguagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauauggcuucucaaaauuggaacaauuaugacccaacagaagaaaucccagccccucugggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaucaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuaugucacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7614 - RNA, 1617 nt, Artificial Sequence
  VP1__Norovirus_and/or_Norovirus-like__AB972527
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggccaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagauauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguaggcguuaa

SEQ ID NO: 7615 - RNA, 1617 nt, Artificial Sequence
  VP1__Norovirus_and/or_Norovirus-like__AB972525
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuugggcccugaucugaaccccuaccuaucucauuuggccagaauguauaaugguuaugcaggugguuuugaagugcaggugauucucgcggggaacgcguucaccgccgggaaaaucauauuugcagcagucccaccaaauuuuccaacugaaggcuugagucccagucaggucaccauguucccccauauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagaaaugaccaacucaagguuccccauuccuuuggagaaguuguucacgggucccagcagugccuuuguuguucaaccacaaaauggcagaugcacaacugauggcgugcucuuaggcacuacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccaguuggugucauccaggaugguggcaccacccaccgaaaugaaccucaacagugggugcucccaaguuauucagguagaaaugucccuaauguacaccuagccccugcuguagcccccacuuuuccgggugaacaacuccuuuucuuuagguccacugugcccggaugcagcggguaucccaacauggacuuggacugccugcuaccccaggagugggugcagcacuucuaccaagaggcagcuccagcacaaucugauguggcucuauugagauucgugaauccagacacggguaggguccuguuugagugcaaacuucauaaaucagguuaugucacaguggcccacaccggccagcaugauuuggucaucccccccaaugguuauuuuagguuugauuccuggguuaaccaauucuacacgcuugcccccaugggaaacggaacggggcguagacguuaa

SEQ ID NO: 7616 - RNA, 1617 nt, Artificial Sequence
  VP1__Norovirus_and/or_Norovirus-like__KT780388
augaagauggcgucgagugacgccaacccaucugauggguccgcagccaaccucgucccagaggucaacaaugagguuauggcucuggagcccguuguuggugccgccauugcggcaccuguagcgggccagcaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauccucgcggggaacgcguucaccgccgggaaggucauauuugcagcagucccaccaaacuucccaacugaaggcuugagccccagccaggucacuauguucccccauauagugguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuuccugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaccacagguagucauaacuacacaaugaauuuggcuucucaaaauuggagcaauuaugacccaacagaagaaaucccagccccucuaggaacuccagauuuuguugggaagauucaaggcgugcucacccaaaccacaaggacagauggcucaacacgcggccacaaagccacaguguacacugggagcgccgacuuugcuccaaaacuggguagaguucaauuugcaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacguuaa

SEQ ID NO: 7617 - RNA, 1617 nt, Artificial Sequence
  VP1__Norovirus_and/or_Norovirus-like__KT780373
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauccucgcggggaacgcguucaccgccgggaaggucauauuugcagcagucccaccaaauuucccaacugaaggcuugagccccagccaggucacuauguucccccauauaguaguagauguuaggcaacuagaaccuguguugauucccuuacccgaugucaggaauaauuucuaucauuacaaucaaucaaaugaucccaccauuaaguugauagcaauguuguauacaccacuuagggcuaauaaugcuggggaugaugucuucacaguuucuugccggguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguugggaagauucaaggcgugcucacccaaaccacaaggacagauggcucaacacgcggccacaaagccacaguguacacugggagcgccgacuuugccccaaaacuggguagaguucaauuugcaacugacacagaccaugauuuuguagcuaaccaaaacacaaaguucaccccaguuggugucauccaagaugguggcaccacccaccgaaaugaaccccaacagugggugcucccaaguuacucaggcagaaacacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7618 - RNA, 1617 nt, Artificial Sequence
  VP1__Norovirus_and/or_Norovirus-like__AB933723
augaagauggcgucuaacgacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccuaucucauuuggccagaauguauaauaguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagugccuuuguuguucaaccacaaaauggcagaugcacgacugauggugugcucuuaggcaccacccaacugucuccugucaacaucugcaccuucagaggggaugucacccacauugcaaguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccgcuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7619 - RNA, 1617 nt, Artificial Sequence
  VP1__Norovirus_and/or_Norovirus-like__AB933708
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaaucuuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7620 - RNA, 1617 nt, Artificial Sequence
  VP1__Norovirus_and/or_Norovirus-like__LC066046
augaagauggcgucgagugacgccaacccaucugauggguccgcagccaaccucgucccagaggucaacaaugagguuauggcucuggagcccguugucggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucucauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaccacagguagucauaacuacacaaugaauuuggcuucucaaaauuggagcaauuacgacccaacagaagaaaucccagccccucuaggaacuccagacuuuguggggaagauucaaggcgugcuuacccaaaccacaaggacagauggcucaacacgcggccacaaagccacaguuuauacugggagcgccgacuuugcuccaaaacuggguagaguucaauuugaaacugacacaaaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagguuugugaauccagacacagguaggguuuuguuugaauguaagcuucauaaaucagguuaugucacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7621 - RNA, 1617 nt, Artificial Sequence
  VP1__Norovirus_and/or_Norovirus-like__KJ678140
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauguaguaauagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaaacuaaccaaaacacaaaauucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7622 - RNA, 1617 nt, Artificial Sequence
  VP1__Norovirus_and/or_Norovirus-like__KJ678139
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7623 - RNA, 1617 nt, Artificial Sequence
  VP1__Norovirus_and/or_Norovirus-like__EU921383
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuugugcaagccccugguggagaguucacaguaucccccagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccacaaagcuacaguuuacacugggagugcccccuuuacuccaaaacugggcaguguucaauucaguacugauacagaaaaugauuuugaagcucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7624 - RNA, 1617 nt, Artificial Sequence
  VP1__Norovirus_and/or_Norovirus-like__KP176405
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugagcuaaaucccuaccuaucccauuuggccagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagauguuacccauaucacagguagucguaacuacacaaugaacuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccgguugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7625 - RNA, 1617 nt, Artificial Sequence
  VP1__Norovirus_and/or_Norovirus-like__KP176403
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugacuaauucaagauuccccauuccuuuagaaaaguuguucacgggucccagcagugccuuuguuguccaaccacaaaacggcaggugcacgacugauggcgugcuccuaggcaccacccaauugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuugugggaaagauucaaggcgugcucacccaaaccacaaggacagauggcucaacacguggccacaaagcuacaguauacacugggagcgcugauuuugcuccaaaacuggguagaguucaauuugaaacugacacagaccaugauuuugaagcuaaccaaaacacaagguucaccccaguuggugucauccaagaugguggcaccacccaccgaaaugaaccccaacagugggugcucccaaguuacucaggcaggaacacuccuaaugugcaucuggccccugcuguagcccccacuuuuccgggugagcaacuucucuucuucagauccaccaugcccggaugcagcggguaccccaacauggauuuggacugucugcucccccaggaaugggugcagcacuucuaccaagaggcagccccagcacaaucugauguggcucugcuaagguuugugaauccagacacagguaggguuuuguuugaauguaagcuucauaaaucaggcuauguuacaguggcucacacuggccagcaugauuugguuaucccccccaaugguuauuuuagguuugauuccugggucaaccaguuuuacacgcuugcccccaugggaaauggaacggggcguagacguuaa

SEQ ID NO: 7626 - RNA, 1617 nt, Artificial Sequence
  VP1__Norovirus_and/or_Norovirus-like__KP096343
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauccucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggccaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccguuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagugccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcucgcccccaugggaaauggaacggggcguagacguuaa

SEQ ID NO: 7627 - RNA, 1617 nt, Artificial Sequence
  VP1__Norovirus_and/or_Norovirus-like__KM268101
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggcuagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguuuccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggaugaugucuuuacaguuucuugccgaguucucacgagaccaucccccgauuuugauuuuauauuucuagugccacccacaguugagucaaggacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaauaucugcaccuucagaggagaugucacccauaucacagguagucauaacuauacaaugaauuuggcuucucaaaauuggaacaauuaugacccaacagaagaaaucccagccccucuaggaacuccagauuuuguggggaagauucaaggcgugcucacucaaaccacaaggacagauggcucaacacgcggccacaaagcuacaguguacacugggagcgccgauuuugcuccaaaacuggguagaauucaauuugaaacugacacaaaccaugauuuugaagcuaaccaaaacacaaaguucaccccaguuggugucauccaagaugguggcaccacccaccgaaaugaaccccaacagugggugcucccaaguuacucgggcagaaauacuccuaaugugcaucuggcccccgcuguggcccccacuuuuccgggugagcagcuucucuuuuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaucaguuuuacacgcuugcccccaugggaaacggaacggggcguagacguuaa

SEQ ID NO: 7628 - RNA, 1617 nt, Artificial Sequence
  VP1__Norovirus_and/or_Norovirus-like__KM198568
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucccauuuggccagaauguauaaugguuaugcagguggcuuugaagugcaggugauccucgcgggaaacgcguucaccgccggaaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaacgauucuaccauuaaauugauagcaaugcuguacacaccacuuagggcuaauaaugcuggggaagaugucuucacagucucuugucgaguccucacgaggccauccccugauuuugauuuuauauuuuuggugccacccacaguugagucaagaaccaaaccauuuacugucccaaucuuaacuguugaagaaaugaccaauucaagauuccccaucccuuuggaaaagcuguucacgggccccagcggugccuuuauuguccaaccacaaaaugguagaugcacgaccgauggcgugcucuuaggcaccacccaacugucuccugucaacaucugcaccuucagagggggugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggagugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucauccccccuaauggcuauuuuagguuugauuccuggguuaaccaauucuauacacuugcccccaugggaaauggaacggggcguagacguuaa

SEQ ID NO: 7629 - RNA, 1617 nt, Artificial Sequence
  VP1__Norovirus_and/or_Norovirus-like__KM198532
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaccccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccguuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcacuacccaccgaaaugaaccccaacaaugggugcucccaaguuauucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcgucggcgcuaa

SEQ ID NO: 7630 - RNA, 1617 nt, Artificial Sequence
  VP1__Norovirus_and/or_Norovirus-like__KM198527
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7631 - RNA, 1617 nt, Artificial Sequence
  VP1__Norovirus_and/or_Norovirus-like__KF177448
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgcugggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaagugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccagccacaaaacggcaggugcacgacugauggcgugcuccuaggcaccacccaacugucuccugucaacaucugcacuuucagaggagaugucacccauaucacagguagucguaacuacacaaugaauuuggcuucccaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugauacagaccaugacuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugaacaacuucucuucuucagauccaccaugcccggaugcagcggguaccccaauauggauuuggacugucugcucccucaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7632 - RNA, 1617 nt, Artificial Sequence
  VP1__Norovirus_and/or_Norovirus-like__KF008244
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcacccuugggcccugaucuaaaucccuaccuaucccauuuggccagaauguacaaugguuaugcaggugguuuugaagugcaaguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcgugcuuacccaaaccacaaggacagauggcucaacacgcggccacaaagccacaguguacacugggagcgccgacuuugcuccaaaacuggguagaguucaauuugaaacugacacagaccaugauuuugaaacuaaccaaaacacaaaguucaccccagucggugucauccaagaugguagcaccacccaccgaaaugaaccccaacagugggugcucccaaguuacucaggcagaaauacucauaaugugcaucuggcccccgcuguagccccuacuuuuccgggugagcaacuccucuucuucagguccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7633 - RNA, 1617 nt, Artificial Sequence
  VP1__Norovirus_and/or_Norovirus-like__KF060103
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucacugccgggaaaaucauauuugcagcagucccaccaaauuucccgacugaagguuugagccccagccaggucacuauguucccccacauaauaguagauguuaggcaauuggaaccuguguugauccccuuacccgauguuaggaacaauuucuaccauuauaaucaaucaaaugaccccaccaucaaauugauagcaauguuguacacaccacuuagggcuaauaaugccggggacgaugucuucacgguuucuugucgaguucucacgagaccaucccccgauuuugauuucauauuuuuggugccacccacaguugaaucaagaacuaaaccauucucuguuccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuucaggcagucauaacuacacaaugaauuuggccucccaaaauuggaacaguuacgauccaacagaagaaaucccagccccucuaggaacuccagauuucguggggaaaauucaaggugugcucacccaaaccacaaggacagauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggauggugguacuacccaccgaaaugaaccccaacaaugggugcucccaaguuacucaggcagaaacauccauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacguuaa

SEQ ID NO: 7634 - RNA, 1617 nt, Artificial Sequence
  VP1__Norovirus_and/or_Norovirus-like__KC960615
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucacuauguucccccacauaauaguagauguuaggcaacuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacccaaaccacaaaaggagauggcucgacccguggccauaaagcuacaguuuacacugggagugcccccuuuacuccaaagcugggcaguguucaauucaguacugacacagaaaaugauuuugaaauucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuucccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucauuccccccaauggcuauuuuagguuugauuccuggguuaaucaguucuacacgcuugcccccaugggaaacggaacggggcguaggcgcuaa

SEQ ID NO: 7635 - RNA, 1617 nt, Artificial Sequence
  VP1__Norovirus_and/or_Norovirus-like__KC517373
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaccccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggccaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaauucaggguuccccauuccuuuggagaaguuguucacgggucccagcagugccuuuguuguucaaccacaaaacggcagaugcacaacugauggcgugcucuuaggcaccacccagcugucuccugucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagguccaaggugugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccgcccaccgaaaugaaccucaacaaugggugcucccaaguuauucagguagaaaugucccuaauguacaccuagccccugcuguagcccccacuuuuccgggugaacaacuccuuuucuuuagguccacuaugccgggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcgugauuuggucaucccccccaaugguuauuuuagguuugauuccuggguuaaccaauucuacacgcuugcccccaugggaaacggaacggggcguagacguuaa

SEQ ID NO: 7636 - RNA, 1617 nt, Artificial Sequence
  VP1__Norovirus_and/or_Norovirus-like__JX459615
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugaauuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccaugggaaauggaacggggcguagacguuaa

SEQ ID NO: 7637 - RNA, 1617 nt, Artificial Sequence
  VP1__Norovirus_and/or_Norovirus-like__JX459603
augaagauggcgucgaaugacgccaccccaucugauggggucgcagcccaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccaguggugccuuuguuguucaaccacaaaauggcagaugcacgacugauggcgugcucuuagguaccacccaacugucuccugucaacaucugcaccuucagaggggaugucacccacauugcagguucucgcaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7638 - RNA, 1617 nt, Artificial Sequence
  VP1__Norovirus_and/or_Norovirus-like__JX155746
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagcuccugguggagaguucacaguguccccuagaaacgcuccgggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagccaggucacuauguucccccacauaauaguggauguuaggcaauuggaaccuguguugaucccuuuaccugauguuaggaauaacuucuaucacuauaaucagucaaaugauucuaccauuaaauugauagcaaugcuguauacaccacuuagggcuaauaaugcuggggaagauguuuucacagucucuugucgaguucucacgagaccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccggauuucgugggaaagauccaagguaugcucacccaaaccacaaagggagaugguucgacccguggccauaaagcuacaguuuacacugggagugcccccuuuaccccaaagcugggcaguguucaauucaguacugauacagaaaaugauuuugaaacucaccaaaacacaaaauucaccccaguuggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggacugccuacucccucaggagugggugcagcacuucuaccaagaggcagcuccagcacaaucugauguggcccuauugagauucgugaauccagacacggguaggguccuguuugaguguaaacuucauaaaccaggcuaugucacaguggcucacaccggccagcaugauuugguuaucccccccaaugguuauuuuagguuugauuccuggguuaaucaauucuacacacuugcccccaugggaaauggaacggggcguagacguuaa

SEQ ID NO: 7639 - RNA, 1617 nt, Artificial Sequence
  VP1__Norovirus_and/or_Norovirus-like__AB541333
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuagacccugaucugaaucccuaccuaucucaauuggccagaauguauaaugguuaugcaggugguuuugaagugcaggugauccucgcggggaacgcguucaccgccgggaaaauuauauuugcagcagucccaccaaauuuuccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccagucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacguuaa

SEQ ID NO: 7640 - RNA, 1617 nt, Artificial Sequence
  VP1__Norovirus_and/or_Norovirus-like__AB541220
augaagauggcgucgaaugacgccaacccaucugauggguccgcagccaaccucgucccagagguuaacaaugagguuauggcuuuggagcccguugucggugccgcuauugcggcgccuguagcgggccaacaaaauguaauugaccccuggauuagaaauaauuuuguacaagccccugguggagaguuuacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucgcaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuuuauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7641 - RNA, 1617 nt, Artificial Sequence
  VP1__Norovirus_and/or_Norovirus-like__AB504312
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuagaaauaauuucuaucauuauaaucaaucaaaugacuccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacucaaaccacaaggagggauggcucgacccgcggucacaaagccacagugagcacuggaaguguccacuucaccccaaagcugggcaguguucaauucuccacugacacaagcaaugacuuugaaacuggccaaaacacgagauucaccccagucggugucguccaggaugguaguaccacccaucaaaaugaaccccaacaaugggugcucccaaacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcgagcuucauaagucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7642 - RNA, 1617 nt, Artificial Sequence
  VP1__Norovirus_and/or_Norovirus-like__GQ849126
augaagauggcgucgagugacgccaacccaucugauggguccacagccaaccuugucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugacuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccagguuacuauguucccccauauaguaguagauguuaggcaauuggaaccuguguugauccccuuacccgauguuaggaauaauuucuaucacuauaaucaaucaaaugaccccaccaucaaauugauagcaauguuguauacaccacucagggcuaauaaugcuggggacgaugucuucacagucucuugucggguucucacgagaccaucccccgauuuugauuucauauuuuuagugccacccacaguugagucaagaacuaaaccauucucugucccaaucuuaacuguugaggagaugaccaauucaagauuccccauuccuuuggaaaaguuguucacgggucccagcagugccuuuguuguucaaccacagaaugguaggugcacgacugauggcgugcuccuagguacuacccaacugucuccugucaacaucugcaccuucagagggaaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacgaggagggauggcucgacccguggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaaugggugcucccaaauuauucagguagagauagucacaaugugcaccuagccccugcuguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagguuugauuccugggucaaccaauucuacacacuugcccccaugggaaauggaacggggcguagacguuaa

SEQ ID NO: 7643 - RNA, 1617 nt, Artificial Sequence
  VP1__Norovirus_and/or_Norovirus-like__AB447459
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuuuuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguuuacucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuuauuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcagacguuaa

SEQ ID NO: 7644 - RNA, 1617 nt, Artificial Sequence
  VP1__Norovirus_and/or_Norovirus-like__EU078413
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaaugguuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaauaauuucuaucacuacaaccaaucaaaugacuccaccauuaaauugauagcaaugcuguacacaccacuuagggcuaauaaugcuggggacgaugucuucacagucucuugucgaguccucacgaggccaucccccgauuuugauuucauauuuuugguaccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucaggggggaugucacccacauugcaggcacucgaaauuacacaaugaauuuggcuucucaaaauuggaacaauuaugacccaacagaagaaaucccagccccucuggggaccccagauuucgugggaaggauccaaggcaugcucacccaaacuacaaggagggaugguucuacccgcggccacaaagcuacagugagcacuggggaugcccacuucacuccaaagcugggcaguauuauguucagcacugauacagacaaugauuuugaaacuggccaaaacacaaaauucaccccagucgguguuguucaggaugguaauggcacccaccaaaaugaaccccaacaaugggugcucccaagcuacucagguagaacuggucauaauguacaccuagcccccgccguagcccccacuuuuccgggugagcaacuucuuuucuucaggucuacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucagguuaugucacaguggcucacacuggccagcaugauuugguuaucccccccaauggcuacuuuagauuugauuccugggucaaccaauucuacacacuugcccccaugggaaaugggacggggcguaggcguuaa

SEQ ID NO: 7645 - RNA, 1617 nt, Artificial Sequence
  VP1__Norovirus_and/or_Norovirus-like__EU078411
augaagauggcgucgaaugacgccagcccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugaccccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacagaauggcaggugcacgacugauggcgugcucuugggcacuacccaacugucccccgucaacaucugcaccuucagaggggaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugccuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuugguuaucccccccaauggcuacuuuagauuugauuccugggucaaccaguucuacacacuugcccccaugggaaauggagcggggcguagacguuaa

SEQ ID NO: 7646 - RNA, 1617 nt, Artificial Sequence
  VP1__Norovirus_and/or_Norovirus-like__AB385632
augaagauggcgucgagugacgccaacccaucugauggguccacagccaaccucgucccagaggucaacaaugagguuauggcuuuggagcccguuguuggugccgcuauugcggcaccuguagcgggccaacagaauguaauugaccccuggauuagaaauaauuuuguacaagccccugguggagaguuuacaguauccccuagaaacgcuccaggugaaauacuauggagcgcgccccugggcccugauuugaaucccuaccuuucccauuuggcuagaauguacaauaguuaugcaggugguuuugaagugcagguaauccucgcggggaaugcguucaccgccggaaaaaucguauuugcagcagucccaccaaauuucccaacugaaggcuugagccccagccaggucacuauguucccccacauaauaguagauguuaggcaacuggaaccuguguugaucccuuuacccgauguuaggaauaauuucuaucacuauaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaauggcaggugcacgacugauggcgugcucuuagguacuacccaacugucuccugucaacaucuguaccuucagaggggaugucacccacauugcugguacucaagaauacacaaugaaucuggccucccaaaacuggaacaauuaugacccaacagaagaagucccagccccucugggaacuccagauuucauggguaagauccaaggcgugcucacccaaaccacaaggagggauggcucgacccgcggucacaaagccacagugagcacuggaaguguccacuucaccccaaagcugggcagaauucaauucuccaccgauacaaguaaugauuuugaaacuggccaaaacacgagauucaccccagucgguguuguccaggaugguaguaccacccaccaaaaugaaccccaacaauggguacucccaaauuauucagguagagauagccacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaguccagacacagguaggguucuguuugaguguaagcuucacaaaucaggcuaugucacaguggcucacacuggccaacaugauuuaguuaucccccccaauggcuauuuuagauuugauuccugggucaaccaguucuacacacuugcccccaugggaaauggaacggggcguagacguuaa

SEQ ID NO: 7647 - RNA, 1617 nt, Artificial Sequence
  VP1__Norovirus_and/or_Norovirus-like__EU839595
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugguuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguucgagugcaaacuucauaaaucaggcuaugucacaguggcucacaccggccagcaugauuuggucaucccccccaaugguuauuuuagguuugauuccuggguuaaucaauucuacacacuugcccccaugggaaaugggacggggcguagacguuaa

SEQ ID NO: 7648 - RNA, 1617 nt, Artificial Sequence
  VP1__Norovirus_and/or_Norovirus-like__AB294788
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagaugucaggcaacuggaaccuguguugauccccuugccugauguuaggaacaauuucuaucauuacaaucaaucaaaugacuccaccaucaaauugauagcaaugcuguacacaccacuuagggcuaacaaugcuggggacgaugucuucacagucucuugucgaguucucacgagaccaucccccgacuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggugugcucuuagguacuacccaacugucuccugucaacaucugcaccuucagaggggaugucacccacauugcaggcacucaaaauuacacaaugaaucuggccucccaaaauuggaacaauuaugacccaacagaagaaaucccagccccucugggaaccccagauuuuguaggaaagauccaaggcgugcucacccaaaccacaacgagggauggcucgacccgcggccacaaagccacagugagcacuggaaguguccacuuuaccccaaagcugggcaguguucaauucuccacugauacaagcaaugacuuugaaaccggccaaaacacgagauucaccccagucggugucguccaggaugguagcaccacccaccaaaaugaaccccaacaaugggugcucccagacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugaguguaagcuucauaaaucaggcuauguaacaguggcucacacuggccaacaugauuugguuaucccccccaaugguuauuuuagauuugauuccugggucaaccaauuuuacacacuugcccccaugggaaauggagcggggcguagacguuaa

SEQ ID NO: 7649 - RNA, 1617 nt, Artificial Sequence
  VP1__Norovirus_and/or_Norovirus-like__AB303936
augaagauggcgucgaaugacgccaccccaucugauggguccacagccaaccucgucccagaggucaacaaugagguuauggcucuggagcccguuguuggugccgcuauugcggcaccuguagcgggccaacagaauguaauugaccccuggauuagaaauaauuuuguacaagccccugguggagaguuuacaguauccccuagaaacgcuccaggugaaauacuauggagcgcgcccuugggcccugaucugaauccuuaccuuucucauuuggccagaauguacaauggcuaugcagguggcuuugaagugcagguaauccuugcggggaaugcguucaccgccgggaaaaucauauuugcagcagucccaccaaguuucccaacugaaggcuugagccccagccagguuacuauguucccccauauaauaguagauguuaggcaacuggaaccuguguugauccccuuaccugauguuaggaacaauuucuaucacuacaaccaaucaaaugaccccacuauuaaauugauagcaaugcuguacacaccacuuagggcuaauaaugcuggggaagaugucuucacagucucuugucgaguccucacgaggccaucccccgauuuugauuucauauuccuggugccacccacaguugagucaaggacuaaaccauucaccgucccaaucuuaacuguugaagaaaugaccaauucaagauuccccauuccuuuggaaaagcuguucacggguccuagcggcgccuuuguuguucaaccacaaaauggcaggugcacgacagauggcgugcucuuaggcacuacccaacuaucuccugucaauaucugcaccuucagaggggaugucacccacauugcagguacucauaauuacacaaugaauuuggcuucucaaaauuggaacaauuaugacccaacagaagaaaucccagccccuuuggggaccccagauuucgugggaaggauccaaggcaugcucacccaaaccacaaggggggauggcucuacccgcggccacaaagcuacagugagcacuggggauguccacuucacuccaaagcugggcaguguucaauucgacacugauacaaacagugauuuugaaacuggccaaaacacgaaauucaccccagucgguguuguccaggaugguaauggugcccaccaaaaugaaccucaacaaugggugcucccaagcuacucagguagaacuggccacaaugcacaccuagcccccgccguggccccuacuuuuccaggugagcagcuucuuuucuucagguccacuaugcccggaugcagcggguaccccaacaugaauuuggauugucuacucccccaggaaugggugcagcacuucuaccaagaggcagcuccagcacaaucugauguggcccugcuaagauuugugaauccagacaccgguaggguucuauuugagugcaagcuucauaaaucaggcuaugucacaguggcccacacuggucagcaugauuugguuaucccccccaauggcuacuuuagauuugauuccugggucaaccaguucuacacacuugcccccaugggaaaugggacggggcguagacguuaa

SEQ ID NO: 7650 - RNA, 1617 nt, Artificial Sequence
  VP1__Norovirus_and/or_Norovirus-like__AB303935
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucacuuggccagaauguacaauggcuaugcagguggcuuugaagugcagguaauccuugcggggaaugcguucaccgccgggaaaaucauauuugcagcagucccaccaaguuucccaacugaaggcuugagccccagccaaguuacuauguucccccauauaauaguagauguuaggcaacuggaaccuguguugauccccuuaccugauguuaggaacaauuucuaucacuauaaucaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuagguacuacccaacugucuccugucaacaucugcaccuucagaggggaugucacccacauugcaggcacucauaauuacacaaugaauuuggcuucucaaaauuggaacaacuaugacccaacagaagaaaucccagccccucuggggaccccagauuucgugggaaggauccaaggcaugcucacccaaacuacaaggggggauggcucuacccgcggccacaaagccacagugagcacuggggauguccauuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcaacacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7651 - RNA, 1617 nt, Artificial Sequence
  VP1__Norovirus_and/or_Norovirus-like__AY588018
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucugaaccccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuuaagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauucccuauuccuuuggaaaaguuguucacggguccuaguggugccuuuguuguucaaccacaaaauggcagguguacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcugggcaguguucaguucaacacugauacaaacaaugauuuugaaacuggccaaaacacgaaauucaccccagucgguguuguccaggaugguaauggugcccaccaaaaugaaccucaacaaugggugcucccaagcuacucagguagaacuggccauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaucaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuauuuuagguuugauuccugggucaaccaauucuacacacuugcccccaugggaaaugggacggggcguagacguuaa

SEQ ID NO: 7652 - RNA, 1617 nt, Artificial Sequence
  VP1__Norovirus_and/or_Norovirus-like__KU678203
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccacauaguaguagauguuaggcaauuagaaccuguguugauucccuuacccgauguuaggaauaauuucuaucauuacaaucaaucaaaugaccccaccauuaaguugauagcaauguuguauacaccacuuagagcuaauaaugcuggggaugaugucuucacaguuucuugccgaguucucacgagaccaucccccgauuuugacuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuacgacccaacagaagaaaucccagccccucuaggaacuccagacuuuguggggaagauucaaggcgugcuuacccaaaccacaaggacagauggcucaacacgcggccacaaagccacaguguacacugggagcgccgacuuugcuccaaaacuggguagaguucaauuugaaacugacacaaaccaugauuuugaagcuaaccaaaacacaaaguucaccccaguuggugucauccaagaugguggcaccacccaccggaaugaaccccaacagugggugcucccaaguuacucaggcagaaauacuccuaaugugcaucuggcccccgcuguagcccccacuuuuccaggugagcaacuucucuucuucagauccaccaugcccggaugcagcggguaccccaacauggauuuggacugucugcucccccaggaaugggugcaguacuuuuaccaagaggcagccccagcacaaucugauguggcucuacuaagauuugugaauccagacacagguaggguuuuguuugaauguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7653 - RNA, 1617 nt, Artificial Sequence
  VP1__Norovirus_and/or_Norovirus-like__KP176410
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaauuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaacuacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccuggugagcaacuucucuucuucagauccaccaugcccggaugcagcggguaccccaacacggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7654 - RNA, 1617 nt, Artificial Sequence
  VP1__Norovirus_and/or_Norovirus-like__KX371609
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccuggcggagaguucacaguauccccuagaaacgcuccaggugaaauacuauggagcgcgcccuuaggcccugaucugaaccccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagaaaugaccaauucaagguuccccaucccuuuggagaaguuguucacgggucccagcagugccuuuguuguucaaccacaaaauggcagaugcacaacugauggcgugcucuuaggcaccacccagcuguccccugucaacaucugcaccuucagaggagaugucacccacauugcagguucucguaauuacacaaugaauuuggcuucucuaaauuggaacaauuaugacccaacagaagaaauuccagccccccuaggaacuccagauuucgugggaaagauccaagguaugcucacucaaaccacaaggggagauggcucgacccguggccauaaagcuacaguuuacacugggagugcccccuucaccccgaagcugggcaguguccaauucgaaacugacacagaaaaugauuuugaaacccaccaaaacacaaaauucaccccagucggugucauccaggaugguggcaccacccaccguaaugaaccucaacaaugggugcucccaaguuauucagguagaaaugucccuaaugugcaccuagccccugcuguagcccccacuuuuccgggugaacaacuccucuucuuuagguccacuaugcccggaugcagcggguaucccaacauggauuuggacugccugcuaccccaggagugggugcagcacuucuaccaagaggcagcuccagcacaaucugauguggcucuauugagauuugugaauccagacacggguaggguccuguuugagugcaaacuucauaaaucgggcuaugucacaguggcccacaccggccagcaugauuuggucaucccccccaaugguuauuuuagguuugauuccuggguuaaccaauucuacacgcuugcccccaugggaaacggaacggggcguagacguuaa

SEQ ID NO: 7655 - RNA, 1617 nt, Artificial Sequence
  VP1__Norovirus_and/or_Norovirus-like__KX354130
augaagauggcgucgagugacgccaacccaucugauggguccgcagccaaccucgucccagaggucaacaaugagguuauggcucuggaacccguuguuggugccgcuaucgcggcaccuguagcgggccaacaaaauguaauugaccccuggauuagaaacaauuuuguacaagccccugguggagaguuuacaguauccccuagaaacgcuccaggugaaauacuauggagcgcgcccuuaggaccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagucaggucacuauguucccccauauaguaguggauguuaggcaacuagaaccuguguugauucccuuacccgauguuaggaauaauuuuuaucauuauaaucaaucaaaugaccccacuauuaaguugauagcaauguuguauacuccacucagagcuaacaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaggcuguucacgggucccagcagugccuuuguuguucaaccacaaaacggcaggugcacgacugauggcgugcuccuaggcacuacccaacugucuccugucaacaucugcaccuucagaggagauaucacccacaucacagguagucauaacuacacaaugaauuuggcuucucaaaauuggaacaauuaugacccaacagaagaaaucccagccccccuaggaacuccagacuuuguagggaagauucaaggcgugcucacccaaaccacaaggacagauggcucaacacgcggccacaaagccacaguguacacugggagcgccgaauuugcuccaaaacuggguagaguccaauuugaaacugacacaaaccaugauuuugaagcuaaccaaaacacaaaguucaccccagucggugucauccaagaugguagcaccacccaccgaaaugaaccccaacagugggugcucccaaguuacucaggcagaaauacucacaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagguuugugaauccagacacagguaggguuuuguuugaguguaagcuucauaaaucaggcuauauuacaguggcucacacuggccaacaugauuugguuauuccccccaaugguuauuuuagauuugauuccugggucaaccaguucuacacgcuugcccccaugggaaauggaacggggcguaaacguuaa

SEQ ID NO: 7656 - RNA, 1617 nt, Artificial Sequence
  VP1__Norovirus_and/or_Norovirus-like__KX354120
augaagauggcgucgagugacgccaacccaucugauggguccgcagccaaccucgucccagaggucaacaaugagguuauggcucuggagcccguuguaggugccgccauugcggcgccuguagcgggccaacaaaauguaauugaccccuggaucagaaauaauuuuguacaagccccugguggagaguucacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaagguuugagccccagccaggucaccauguucccccauauaguaguagauguuaggcaacuagaaccuguguugauucccuuacccgauguuaggaauaauuucuaucauuauaaucaaucaaaugaccccaccauuaaguugauagcaauguuguacacaccacuuagggcuaauaaugcuggggaugaugucuucacaguuucuugccgaguucucacgagaccaucccccgauuuugauuuuauauuucuagugccacccacaguugagucaagaacuaaaccauucucugucccagucuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaguaauuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaagcuggguagaguucaauuugaaacugacacagaccaugauuuugaaguuaaccaaaacacaaaguucaccccaguuggugucauccaagauggcagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacuuccccaggaaugggugcaguacuucuaccaagaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaauggcuauuuuagguuugauuccugggucaaccaguuuuacacgcuugcccccaugggaaauggaacggggcguagacguuaa

SEQ ID NO: 7657 - RNA, 1617 nt, Artificial Sequence
  VP1__Norovirus_and/or_Norovirus-like__KX354113
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuaguaccacccacaguugagucaagaacuaaaccauucucugucccaguuuuaacuguugaggagaugaccaauucaagauuccccauuccuuuggaaagguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagacggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauccaagaugguggcaccacccaccgaaaugaaccccaacagugggugcucccaaguuacucaggcaggaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7658 - RNA, 1617 nt, Artificial Sequence
  VP1__Norovirus_and/or_Norovirus-like__KX354105
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuaguaccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7659 - RNA, 1617 nt, Artificial Sequence
  VP1__Norovirus_and/or_Norovirus-like__KX354077
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaccccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaaucuuaacuguugaagaaaugaccaacucaagguuccccaucccuuuggagaaguuguucacgggucccagcagugccuuuguuguucaaccacaaaauggcagaugcacaacugauggcgugcucuuaggcaccacccagcuguccccuguuaacaucugcaccuucagaggagaugucacccacauugcagguucucguaauuacacaaugaauuuggcuucucuaaauuggaacaauuaugacccaacagaagaaauuccagccccccuaggaacuccagauuucgugggaaagauccaagguaugcucacucaaaccacaaggggagauggcucgacccguggccauaaagcuacaguuuacacugggagugcccccuucaccccaaagcugggcaguguccaauucgaaacugacacagaaaaugauuuugaaacccaccaaaacacaaaauucaccccagucggugucauccaggaugguggcaccacccaccguaaugaaccucaacaaugggugcucccaaguuauucagguagaagugucccuaaugugcaccuagccccugcuguagcccccacuuuuccgggugaacaacuccuuuucuuuagguccacuaugcccggaugcagcggguaucccaacauggauuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccaaugguuauuuuagguuugauuccuggguuaaccaauucuacacgcuugcccccaugggaaacggaacggggcguagacguuaa

SEQ ID NO: 7660 - RNA, 1617 nt, Artificial Sequence
  VP1__Norovirus_and/or_Norovirus-like__KR131785
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaacgcuggggacgaugucuucacaguuucuugccgaguucucacgagaccaucccccgauuuugauuucauauuucuagugccacccacaguugagucaaggacuaaaccauucucugucccaguuuuaacuguugaggagaugaccaauucaagauuccccauuccuuuggaaaaguuguucacgggucccaguagugccuucguuguccaaccacaaaacggcaggugcacgacugauggcgugcuccuaggcaccacccaacugucuccugucaacaucugcaccuucaggggagaugucacccauauuacagguagucauaacuacacaaugaauuuggcuucucaaaauuggaacaauuaugacccaacagaagaaaucccagccccucugggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacaaaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauccccccaaaugguuauuuuagguuugauuccugggucaaccaguuuuacacgcuugcccccaugggaaauggaacggggcguagacguuaa

SEQ ID NO: 7661 - RNA, 1617 nt, Artificial Sequence
  VP1__Norovirus_and/or_Norovirus-like__AB972530
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagacgucacccauaucacagguagucguaacuacacaaugaauuuggcuucucaaaauuggagcaauuaugacccaacagaagagaucccagccccucuaggaacuccagauuuuguggggaagauucaaggcgugcucacccaaaccacaaggacagauggcucaacacguggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7662 - RNA, 1617 nt, Artificial Sequence
  VP1__Norovirus_and/or_Norovirus-like__AB972526
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaacaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacggcaggugcacgacugauggcgugcuccuaggcaccacccagcugucuccugucaacaucugcaccuucagaggagaugucacccauaucacagguagucauaacuacacaaugaauuuggcuucucaaaauuggaacaauuaugacccaacagaagaaaucccagccccucuaggaacuccagauuuuguggggaagauucaaggcgugcucacccaaaccacgaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaauuuuacacgcuugcccccaugggaaauggaacggggcguagacguuaa

SEQ ID NO: 7663 - RNA, 1617 nt, Artificial Sequence
  VP1__Norovirus_and/or_Norovirus-like__AB972522
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccaacuuugcuccaaaacuggguagaauucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuuuuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7664 - RNA, 1617 nt, Artificial Sequence
  VP1__Norovirus_and/or_Norovirus-like__AB972514
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucaucuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcuuuuaggcaccacccagcugucuccugucaacaucugcaccuucagaggggaugucacccacauugcagguucucguaauuauacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccgaguuauucagguagaaaugucccuaauguacaccuagccccugcuguagcccccacuuuuccgggugaacaacuccuuuucuuuagguccauuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaagucaggcuaugucacaguggcccauaccggccagcaugauuuggucaucccccccaaugguuauuuuagguuugauuccuggguuaaccaauucuauacgcuugcccccaugggaaacggaacggggcguagacguuaa

SEQ ID NO: 7665 - RNA, 1617 nt, Artificial Sequence
  VP1__Norovirus_and/or_Norovirus-like__AB972505
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguaguaccgcccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7666 - RNA, 1617 nt, Artificial Sequence
  VP1__Norovirus_and/or_Norovirus-like__AB972473
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggccccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccagucggugucauccaagacgguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7667 - RNA, 1617 nt, Artificial Sequence
  VP1__Norovirus_and/or_Norovirus-like__KT780381
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucaccauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggccaauaaugcuggggaugaugucuucacaguuucuugccgaguucucacgagaccaucccccgauuuugauuuuauauuucuagugccacccacaguugagucaaggacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuuccgaggagaugucacccauaucacaggcagucgcaacuacacaaugaauuuggcuucucaaaauuggagcaacuaugacccaacagaagauaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacgaaguucaccccaguuggagucauccaagaugguggcaccacccaccgaaaugaaccccaacaguggguacucccaaguuacucaggcagaaauacuccuaaugugcaucuagcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7668 - RNA, 1617 nt, Artificial Sequence
  VP1__Norovirus_and/or_Norovirus-like__KT780372
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguacuucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugauguauucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggugugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaacacuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcgcagacguuaa

SEQ ID NO: 7669 - RNA, 1617 nt, Artificial Sequence
  VP1__Norovirus_and/or_Norovirus-like__KT202797
augaagauggcgucgagugacgccaacccaucugauggguccgcagccaaccucgucccagaggucaacaaugagguuauggcucuggaacccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucaaggcgugcucacucaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaguacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7670 - RNA, 1617 nt, Artificial Sequence
  VP1__Norovirus_and/or_Norovirus-like__KR904226
augaagauggcgucgagugacgccaacccaucugauggguccgcagccaaccucguaccagaggucaacaaugagguuauggcuuuggagcccguuguuggugccgcuauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgacguuaggaauaauuucuaucauuauaaucaaucaaaugaccccacuauuaaguugauagcaauguuguauacaccacuuagggcuaauaaugcuggggacgaugucuucacaguuucuugcagaguucucacgagaccaucccccgauuuugauuucauauuuuuagugccacccacaguugagucaagaacuaaaccauucucugucccaguuuuaacuguugaggagaugacuaauucaagauuccccauuccuuuggaaaaguuguucacgggccccagcagugccuuuguuguucaaccacaaaacggcaggugcacgacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaagugcucauaaugugcaucuggcccccgcuguagcccccacuuuuccgggugagcaacuucucuucuucagauccaccaugcccggaugcagcggguaccccaacauggauuuggacugucuacucccccaggaauggguacaguacuucuaccaagaggcagccccagcacaaucugauguggcucugcuaagauuugugaauccagacacagguaggguuuuguuugaguguaagcuacacaaaucaggcuauguuacaguggcucacacuggccaacaugauuugguuaucccccccaaugguuacuuuagauuugauuccuggguuaaccaguucuauacgcuugcccccaugggaaauggaacggggcgcagacguuaa

SEQ ID NO: 7671 - RNA, 1617 nt, Artificial Sequence
  VP1__Norovirus_and/or_Norovirus-like__KR904208
augaagauggcguccagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucguauuuucagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggccccaguaguaccuuuguuguucaaccacaaaacggcaggugcacgacugauggcgugcuccuagguacuacccaacugucuccugucaacaucugcaccuucagaggggaugucacccauauugcaggcagucguaacuacacaaugaaucuggcuucccaaaauuggaacaguuaugacccaacagaagaaaucccagccccucuaggaacuccagauuucguggggaagauucaaggugugcucacccaaaccacaaggacggauggcucgacccgcggccacaaagcuacaguguacacugggagcgccgacuuuucuccaaaacuggguagaguucaauuugccacugacacagacaaugauuuugaugcuaaccaaaacacaaaguucaccccagucgguguuauccaggaugguaauacugcccaccgaaaugaaccccaacaaugggugcucccaaguuacucaggcagaaauacucauaaugugcaccuggcccccgcuguagcccccacuuuuccgggugagcagcuccucuucuucagaucuaccaugcccggaugcagcggguaccccaacauggauuuggacugucugcucccccaggaaugggugcaguacuucuaccaggaggcagccccagcacaaucugauguggcucugcuaagauuugugaauccagauacagguaggguuuuguuugaguguaagcuucauaaaucaggcuauguuacaguggcucacacuggccaacaugauuugguuaucccccccaaugguuacuuuagauuugauuccugggucaaccauuucuauacacuugcccccgugggaaaugggacggggcguagacguuaa

SEQ ID NO: 7672 - RNA, 1617 nt, Artificial Sequence
  VP1__Norovirus_and/or_Norovirus-like__AB933709
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccugucucauuuggccagaauguauaaugguuaugcaggugguuuugaagugcaggugauucucgcggggaaugcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacagaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccacgaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7673 - RNA, 1617 nt, Artificial Sequence
  VP1__Norovirus_and/or_Norovirus-like__EU921352
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaucuuucccauuuggccagaauguacaaugguuaugcaggugguuuugaagugcagguaauccucgcggggaacgcguucacugccggaaaaaucauauuugcagcagucccaccaaauuucccaacugaaggcuugagccccagccaggucacuauguucccccauauaauaguagauguuaggcaacuggaaccuguguugauccccuuacccgauguuaggaauaauuucuaucacuacaaucaaucaaaugacuccaccaucaaauugauagcaauguuguauacaccacuuagggcuaauaaugcuggggacgaugucuucacaguuucuugucgaguucucacgagaccaucccccgauuuugauuucauauuuuuagugccacccacaguugagucaagaacuaaaccauucucugucccaauuuuaacuguugaggagaugaccaauucaagauuccccauuccuuuggaaagguuguucacgggucccagcagugccuuuguuguucaaccacaaaaugguaggugcacgacugauggcgugcuccuagguacuacccaacugucuccugucaacaucugcaccuucagaggggaugucacccacauugcaggcacucaagaauacacaaugaaucuggccucccaaaacuggaacaauuaugacccaacagaagaaaucccagccccucugggaacuccagauuucguggguaagauccaaggcgugcucacccaaaccacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggauggugguaccacccaccaaaaugaaccccaacaauggguacucccagauuauucagguagagauggucacaaugugcaccuagccccugccguggcccccucuuucccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7674 - RNA, 1617 nt, Artificial Sequence
  VP1__Norovirus_and/or_Norovirus-like__LC005735
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuaguaccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagacggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccucccaaugguuauuuuagguuugauuccugggucaaccaguuuuacacgcuugcccccaugggaaauggaacggggcguagacguuaa

SEQ ID NO: 7675 - RNA, 1617 nt, Artificial Sequence
  VP1__Norovirus_and/or_Norovirus-like__KP241909
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaauuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuucccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaacuacaaggacagauggcucaacacgcggccacaaagccacaguguacacugggagcgccgacuuugcuccaaaacuggguagaguucaauuugaaacugacacagaccaugauuuugaaacuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccuggugagcaacuucucuucuucagauccaccaugcccggaugcagcggguaccccaacacggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7676 - RNA, 1617 nt, Artificial Sequence
  VP1__Norovirus_and/or_Norovirus-like__KJ533132
augaagauggcgucgagugacgccaacccaucugauggguccgcagccaaccucgucccagaggucaacaaugagguuauggcucuggagcccguuguuggugccgccauugcggcgccuguagcgggccaacaaaauguaauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuucccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccagcagugggugcucccaaguuacucaggcagaaacacucauaaugugcaucuggcccccgcuguagcccccacuuuuccgggugagcaacuucucuucuucagguccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaauaugauuugguuauuccccccaaugguuauuuuagguuugauuccugggucaaccaguuuuacacgcuugcccccaugggaaauggaacggggcguagacguuaa

SEQ ID NO: 7677 - RNA, 1617 nt, Artificial Sequence
  VP1__Norovirus_and/or_Norovirus-like__KP176407
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugagcuaaaucccuaccuaucccauuuggccagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuccuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagauguuacccauaucacagguagucguaacuacacaaugaacuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccgguugcagcggguaccccaacagggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7678 - RNA, 1617 nt, Artificial Sequence
  VP1__Norovirus_and/or_Norovirus-like__KP176406
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcgggugguuuugaagugcaggugauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaauuccagauuuuguggggaagauucaaggcaugcucacccaaaccacaaggacagauggcucaacacgcggccacaaagcuacaguauacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaacgugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaccaguuuuacacgcuugcccccaugggaaauggaacggggcguaggcguuaa

SEQ ID NO: 7679 - RNA, 1617 nt, Artificial Sequence
  VP1__Norovirus_and/or_Norovirus-like__KP123606
augaagauggcgucgagugacgccaacccaucugauggguccgcagccaaccucgucccagaggucaacaaugagguuauggcucuggagcccguuguuggugccaccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcgggugguuuugaagugcaggugauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaauuccagauuuuguggggaagauucaaggcaugcucacccaaaccacaaggacagauggcucaacacgcggccacaaagcuacaguauacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaccaguuuuacacgcuugcccccaugggaaauggaacggggcguaggcguuaa

SEQ ID NO: 7680 - RNA, 1617 nt, Artificial Sequence
  VP1__Norovirus_and/or_Norovirus-like__KP096335
augaagauggcgucgagugacgccaacccaucugauggguccgcagccaaccucgucccagaggucaacaaugagguuauggcucuggagcccguuguaggugccgccauugcggcaccuguagcgggccaacaaaauguaauugaccccuggauuagaaauaauuuuguacaagccccugguggagaauucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaagguuugagcccuagccaggucacuauguucccccauauaguaguagauguuaggcaacuagaaccuguguugauucccuuacccgauguuaggaauaauuucuaucauuacaaucaaucaaaugaccccaccauuaaauugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuugacuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgauuuugcuccaaaacuggguagaguucaauuugaaacugacacagaccaugauuuugaagcuaaccaaaauacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacucccccaggagugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcgcagacguuaa

SEQ ID NO: 7681 - RNA, 1617 nt, Artificial Sequence
  VP1__Norovirus_and/or_Norovirus-like__KM268095
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccauccccugauuuugacuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuugugggaaagauucaaggcgugcucacccaaaccacaaggacagauggcucaacacgcggccacaaagccacaguguacacugggagcgcugacuuugcuccaaaauuggguagaguucaauuugaaacugacacagaccaugauuuugaaacuaaccaaaacacaaaguucaccccaguuggugucauccaagaugguagcaccacccaccgaaaugaaccccaacagugggugcucccaaguuacucaggcagaaauacuccuaaugugcaucuggcccccgcuguggcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7682 - RNA, 1617 nt, Artificial Sequence
  VP1__Norovirus_and/or_Norovirus-like__KM268094
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcagguaauucucgcggggaacgcguucaccgccgggaagguuauauuugcagcaguuccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaauuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7683 - RNA, 1617 nt, Artificial Sequence
  VP1__Norovirus_and/or_Norovirus-like__KM268093
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaguaauuuuguacaagccccugguggagaguuuacaguauccccuagaaacgcuccaggugaaauauuauggagcgcgcccuugggcccugaucuaaaucccuaccuaucccauuuggccagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucccaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugacuccuggguuaaccaguuuuacacgcuugcccccaugggaaauggaacggggcguagacguuaa

SEQ ID NO: 7684 - RNA, 1617 nt, Artificial Sequence
  VP1__Norovirus_and/or_Norovirus-like__KM198591
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuuuuaucauuauaaucagacaaaugauucuaccauuaaauugauagcaaugcuguauacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7685 - RNA, 1617 nt, Artificial Sequence
  VP1__Norovirus_and/or_Norovirus-like__KM198589
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacuccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaauucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauagaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7686 - RNA, 1617 nt, Artificial Sequence
  VP1__Norovirus_and/or_Norovirus-like__KM198576
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucccauuuggccagaauguauaauggcuaugcagguggcuuugaagugcaggugauccucgcggggaacgcguucaccgccggaaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccacccacaguugagucaagaacuaaaccauuuacugucccaaucuuaacuguugaagaaaugaccaauucaagauuccccaucccuuuggaaaaguuguucacgggccccagcggugccuucauuguucaaccacaaaaugguagaugcacgaccgauggcgugcucuuaggcaccacccaacugucuccugucaacaucugcaccuucagaggggaugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggagugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaccaggcuaugucacaguggcucacaccggccagcaugauuuggucauccccccuaauggcuauuuuagguuugauuccuggguuaaccaauucuacacacuugcccccaugggaaauggaacggggcguagacguuaa

SEQ ID NO: 7687 - RNA, 1617 nt, Artificial Sequence
  VP1__Norovirus_and/or_Norovirus-like__KM198564
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuaggaauaauuuuguacaagccccugguggagaauucacaguauccccuagaaacgcuccaggugaaauacuauggagcgcgcccuuaggcccugaucugaaucccuaccuaucccauuuggccagaauguauaaugguuaugcagguggcuuugaagugcaggugauccucgcggggaacgcguucaccgccgggaaaauuauauuugcagcaguuccaccaaauuuuccaacugaaggcuugagccccagccagguuacuauguucccccacauaauaguagauguuaggcaacuggaaccuguguugauccccuuaccugauguuaggaauaacuucuaucauuauaaucagucaaaugauucuaccauuaaauugauagcaaugcuguacacaccacuuagagcuaauaaugcuggggaagaugucuucacagucucuugucgaguccuuacgaggccauccccugacuuugauuuuauauuuuuggugccacccacaguugagucaagaacuaaaccauuuacugucccaaucuuaacuguugaagaaaugaccaauucaagauuccccaucccuuuggaaaaguuguucacgggccccagcggugccuuuauuguucaaccacaaaaugguagaugcacgacugauggcgugcucuuaggcaccacccaacugucuccugucaacaucugcaccuucagaggggaugucacccacauugcagguucucgcaauuacacgaugaauuuggcuucucuaaauuggaauaauuaugacccaacagaagaaauuccagccccucugggaacuccagauuucgugggaaagauccaaggugugcucacucaaaccacaaagggagauggcucgacccguggccauaaagcaacaguuuacacugggggugcccccuuuacuccaaagcugggcaguguucaauucaguacugacacagaaaaugauuuugaagcucaccaaaacacaaaauucaccccagucggugucauccaggaugguggcaccacccaccgaaaugaaccccaacaaugggugcucccaaguuauucagguagagauguccacaauguacaccuggccccugcuguagcccccacuuuuccgggugaacaacuucuuuucuucagguccacuaugcccggaugcaguggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucauccccccuaauggcuauuuuagguuugacuccuggguuaaccaauucuacacacuugcccccaugggaaauggaacggggcguagacguuaa

SEQ ID NO: 7688 - RNA, 1617 nt, Artificial Sequence
  VP1__Norovirus_and/or_Norovirus-like__KJ716355
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacagucgagucaagaacuaaaccauucucugucccaauuuuaacuguugaggagaugaccaauucaagauuccccauuccuuuggaaaaguuguucacgggucccagcagugccuuuguuguccaaccacaaaacggcaggugcacgacugauggcguacuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7689 - RNA, 1617 nt, Artificial Sequence
  VP1__Norovirus_and/or_Norovirus-like__KJ685408
augaagauggcgucgagugacgccaacccaucugauggguccacagccaaccucgucccagaggucaacaaugagguuauggcuuuggagcccgugguuggugccgcaauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaccccuaccuuucccauuuggccagaauguacaaugguuaugcaggugguuuugaagugcagacaauccucgcggggaacgcguucaccgccgggaaaaucauauuugcagcagucccaccaaauuucccaacugaagguuugagccccagccagguuacuauguucccccacauaauaguagauguuaggcaauuggaaccuguguugauucccuuacccgauguuagaaauaauuucuaccauuacaaucaaacaaaugaccccaccaucaaauugauagcaauguuguacacaccacuuagggccaauaaugccggggacgaugucuucacaguuucuugucgaguucucacaagaccaucccccgauuuugauuucauauuuuuggugccacccacaguugaaucaagaacuaaaccauucucugucccgguuuuaacuguugaggagaugaccaauucaagguuccccauuccuuuggagaaauuauucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacugggcagaguucaauuugccacugauacagacaaugauuuugaaacuaaccaaaauacaaaguucaccccagucgguguuauccaggauggugguaccacccaccaaaaugaaccccaacaauggguacucccaaguuacucaggcagagacacucacaaugugcaccuggcccccgcuguagcucccacuuucccgggcgagcagcuccucuucuucagaucuacuaugcccggaugcagcggguaccccaacauggauuuggacugucugcucccccaggaaugggugcaguauuuuuaccaggaggcagccccagcacaaucugauguggcucuguuaagauuugugaauccagauacagguagggucuuguuugaguguaaacuucauaaaucaggcuauguuacaguggcucacacuggccaacaugauuugguuaucccccccaaugguuauuuuagauuugacuccugggucaaccaguucuacacacuugcccccaugggaaaugggacggggcguagacguuaa

SEQ ID NO: 7690 - RNA, 1617 nt, Artificial Sequence
  VP1__Norovirus_and/or_Norovirus-like__KJ144999
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagccccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcagguguacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccacaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaauuauucagguagaaauguccauaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggagcggggcguagacguuaa

SEQ ID NO: 7691 - RNA, 1617 nt, Artificial Sequence
  VP1__Norovirus_and/or_Norovirus-like__KF060016
augaagauggcgucgagugacgccaacccaucugauggguccacagccaaccucgucccagaggucaacaaugagguuauggcucuugagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccauauaauaguagauguuaggcaauuggaaccuguguugauccccuuacccgauguuaggaauaauuucuaccacuauaaucaaucaaaugaccccaccaucaaauugauagcaauguuguacacaccacuuagggcuaauaaugccggggaugaugucuucacaguuucuugucgaguucucacgagaccaucccccgauuuugacuuuauauuuuuggugccacccacaguugaaucaagaacuaaaccauucucugucccaguuuuaacuguugaggagaugaccaauucaagguuccccguuccuuuggaaaaguuguucacgggccccaguagugccuuuguuguucaaccacaaaacggcaggugcacgacugauggcgugcuccuagguacuacccaacuguccccugucaacaucugcaccuucagaggggaugucacccauauuacaggcagucguaacuacacaaugaauuuagccucccaaaauuggaacaguuacgauccaacagaagaaaucccagccccucuaggaacuccagauuucguggggaagauucaaggugugcucacccaaacaacaaggacgaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguacuaccccccgaaaugaaccccaacaaugggugcucccaaguuacucaggcaggaacauucauaaugugcaccuggcccccgcuguggcccccacuuucccgggcgagcagcuucucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuaugucacaguggcucacacuggccaacaugauuugguuaucccccccaaugguuauuuuagauuugauuccuggguuaaccaguucuacacacuugcccccaugggaaaugggacggggcguaggcguuaa

SEQ ID NO: 7692 - RNA, 1617 nt, Artificial Sequence
  VP1__Norovirus_and/or_Norovirus-like__KC517367
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaccccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagccucuugucgaguucucacgaggccauccccugauuuugauuucauauuuuuggugccaccuacaguugagucaagaacuaagccauuuacugucccaauccuaacuguugaagaaaugaccaauucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccgcccaccgaaaugaaccucaacaaugggugcucccaaguuauucagguagaaaugucccuaauguacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccaaugguuauuuuagguuugauuccuggguuaaccaauucuacacgcuugcccccaugggaaacggaacggggcguagacguuaa

SEQ ID NO: 7693 - RNA, 1617 nt, Artificial Sequence
  VP1__Norovirus_and/or_Norovirus-like__KC517366
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaacuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauucccuuaccugauguuaggaauaauuucuaucacuacaaucagucaaaugauucuaccauuaaauugauagcaaugcuguauacgccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccugucaacaucuguaccuucagaggggaugucacccacauugcagguucucguaauuacacaaugaauucggcuucucuaaauuggaacaauuaugacccaacagaagaaauuccagccccucugggaacuccagauuucgugggaaagauccaagguaugcucacucaaaccacaaagggagauggcucgacgcguggccauaaagcuacaguuuacacugggagugcccccuucacuccaaaguugggcaguguccaauucgaaacugacacagaaaaugauuuugaaacccaccaaaacacaaaauuuaccccagucggugucauccaggaugguggcaccacccaccgaaaugaaccucaacaaugggugcucccaaguuauucagguagaaaugucccuaauguacaccuagccccugcuguagcccccacuuuuccaggugaacaacuccuuuucuuuagguccacuaugcccggaugcagcggguaucccaacauggauuuggauugccugcuaccccaggagugggugcagcacuucuaccaagaggcagcuccagcacaaucugauguggcucuauugagauuugugaauccagacacggguagggucuuguuugagugcaaacuucauaaaucaggcuaugucacaguggcccacaccggccagcaugauuuggucaucccccccaaugguuauuuuagguuugauuccuggguuaaccaauucuacacgcuugcccccaugggaaacggaacggggcguagacguuaa

SEQ ID NO: 7694 - RNA, 1617 nt, Artificial Sequence
  VP1__Norovirus_and/or_Norovirus-like__KC517359
augaagauggcgucgaaugacgccagcccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcgauuggaaccuguguugauccccuuaccugauguuaggaauaauuucuaccacuauaaucagucaaaugauucuaccauuaaauugauagcaaugcuguacacaccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagagaugaccuacucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaaucuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacauaaaauucaccccagucggugucauccaggaugguggcaccacucaccgaaaugaaccucaacaaugggugcucccaaguuauucagguagaaaugucccuaauguacaccuagccccugcuguagcccccacuuuuccgggugaacaacuccuuuucuuuagguccacuaugcccggaugcagcggguaucccaacauggauuuggacugccugcuaccccaggagugggugcagcacuucuaccaagaggcagcuccagcacaaucugauguggcucuauugagauuugugaauccagacacggguaggguccuguuugagugcaaacuccauaaaucaggcuaugucacaguggcccacaccggccagcaugauuugaucaucccccccaaugguuauuuuagguuugauuccuggguuaaccaauucuacacgcuugcccccaugggaaacggaacggggcguagacguuaa

SEQ ID NO: 7695 - RNA, 1617 nt, Artificial Sequence
  VP1__Norovirus_and/or_Norovirus-like__KC409303
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaauccuuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggauggugguaccacccaccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7696 - RNA, 1617 nt, Artificial Sequence
  VP1__Norovirus_and/or_Norovirus-like__JX459608
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaacuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaauacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguauccuaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7697 - RNA, 1617 nt, Artificial Sequence
  VP1__Norovirus_and/or_Norovirus-like__JQ320073
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggccccgaucugaaucccuaccuuucucauuuggccagaauguacaauggcuaugcagguggcuuugaagugcagguaauccuugcggggaaugcguucaccgccgggaaagucauauuugcagcagucccaccaaauuucccaacugaaggcuugagccccagccaggucacuauguucccccauauaguaguagauguuaggcaacuggaaccuguguugauccccuuaccugauguuaggaacaauuucuaucacuacaaccaaucaaaugaccccaccauuaaacugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggucacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuggucauaauguacaccuagcccccgccguagcccccacuuuuccgggugagcaacuucuuuucuucagguccacuaugcccggaugcagcggguacccuaacaugaauuuggauugccuacucccccaagaaugggugcagcacuucuaccaagaggcagccccagcacaaucugauguggcucugcuaagauuugugaauccagacacagguaggguucuauuugagugcaagcuucauaaaucaggcuaugucacaguggcucacacuggccagcaugauuuggucaucccccccaauggcuacuuuagauuugauuccugggucaaccaauucuacacacuugcccccaugggaaaugggacggggcguagacguuaa

SEQ ID NO: 7698 - RNA, 1617 nt, Artificial Sequence
  VP1__Norovirus_and/or_Norovirus-like__HM802552
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguuuacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaucauuauaaucaaucaaaugacuccaccauuaaauugauagcaaugcuguacacaccacuuagggcuaauaaugcuggggaugaugucuucacagucucuugucgaguccucacgaggccaucccccgauuucgauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccaggcacucguacuuacagaaugaauuuggcuucucaaaauuggaacaauuaugacccaacagaagaaaucccagccccccugggaacuccagauuucgugggaaagauccagggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacuguccauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccgucacaaucugauguggcuuuguugagauuugugaauccagacacagguaggguucuguuugagugcaagcuucauaaagcaggcuaugucacaguugcucacacuggccagcaugauuuggucaucccccccaauggcuacuuuagauuugauuccugggucaaccaguucuacacacuugcccccaugggaaauggagcggggcguagacguuaa

SEQ ID NO: 7699 - RNA, 1617 nt, Artificial Sequence
  VP1__Norovirus_and/or_Norovirus-like__AB541320
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaauuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuugucggguucucacgagaccaucccccgauuuugauuucauauuuuuagugccacccacaguugcgucaagaacuaaaccauucucugucccgucaguuacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccggccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccucaacaaugggugcucccaaguuacucaggcagaaauagucacaaugugcaccuggcccccacuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcugagauuugugaauccagacacagguaggguuuuguuugaguguaagcuucauaaaucaggcuauguuacaguggcucacaccggccaacaugauuugguuaucccccccaaugguuauuuuagauuugauuccugggucaaccaguucuacacacuugcccccaugggaaauggaacggggcguagacguuaa

SEQ ID NO: 7700 - RNA, 1617 nt, Artificial Sequence
  VP1__Norovirus_and/or_Norovirus-like__AB541227
augaagauggcgucgaaugacgccaacccaucugauggguccgcagccaaccucgucccagaggucagcaaugagguuauggcuuuggagcccguugucggugccgcuauugcggcgccuguagcgggccaacaaaaugugauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucaccauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaauaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuacuccaaagcuggguaguguucaauucaguacugauacagaaaaugauuuugaaacucaccaaaacacaaaauucaccccagucggugucauccaggaugguggcaccacccaccgaaaugaaccccaacaaugggugcucccaaguuacucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacucgcccccaugggaaauggaacggggcguagacguuaa

SEQ ID NO: 7701 - RNA, 1617 nt, Artificial Sequence
  VP1__Norovirus_and/or_Norovirus-like__AB504318
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuuuuaucacuauaaucagucaaaugauucuaccauuaaauugauagcaaugcuguauacaccacuuagggcuaauaaugcuggggaagaugucuucacagucuccugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaagguuugcucacucaaaccacaaagggagauggcucgacccguggccauaaagcuacaguuuacacugggagugcccccuuuacuccaaagcugggcgguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcgcagacguuaa

SEQ ID NO: 7702 - RNA, 1617 nt, Artificial Sequence
  VP1__Norovirus_and/or_Norovirus-like__AB504311
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaacguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuugccugauguuagaaauaauuucuaucauuauaaucaaucaaaugacuccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacucaaaccacaaggagggauggcucgacccgcggucacaaagccacagugagcacuggaaguguccacuucaccccaaagcugggcaguguucaauucuccacugacacaagcaaugacuuugaaacuggccaaaacacgagauucaccccagucggugucguccaggaugguaguaccacccaucaaaaugaaccccaacaaugggugcucccaaacuauucagguagagauagucauaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaagucaggcuauguaacaguggcucacacuggucaacaugauuugguuaucccccccaauggcuauuuuagauuugauuccugggucaaccaauucuacacacuugcccccaugggaaauggagcggggcguagacguuaa

SEQ ID NO: 7703 - RNA, 1617 nt, Artificial Sequence
  VP1__Norovirus_and/or_Norovirus-like__FJ537135
augaagauggcgucgagugacgccaacccaucugauggguccacagccaaccucgucccagaggucaacaaugagguuauggcuuuggagccuguugucggugcugccauugcagcaccuguggcaggccaacaaaauauaauugaccccuggauuagaaauaauuuugugcaagccccugguggagaguucacaguguccccuagaaaugcuccaggugagauacuauggagcgcgcccuugagcccugauuugaaccccuaucuuucucaccuguccagaauguacaaugguuaugcagguggcuuugaagugcagguaauccucgcagggaaugcguucacugccgggaaaaucauauuugcagcaauuccaccaaauuuuccaacugaaggcuuaagcccuagccagguuacaauguucccccacauaauuguagaugucaggcaauuggaaccuguauuaaucccccuaccugauguuaggaauaauuucuaucauuauaaucaagcacaugauucuacucucaaauugauagcaauguuguauacaccacucagagccaauaaugccggggaugaugucuucacagucucuugucgaguccucacgagaccaucccccgauuuugauuucauauuccuggugccacccacagucgagucaagaacuaagccauucacugucccuaucuuaacuguugaggaaauguccaauucaagauuccccauucccuuagaaaaguuguauacggguccuagcagugcuuuuguuguucaaccacaaaauggcagaugcacgacugauggcgugcuucuaggcacuacucaguugucagcugucaauaucuguaauuucaggggggaugucacccguguugggaucagccaugauuacacaaugaauuuggugucccaaaauuggaauaacuaugauccaacagaggaaaucccugcuccccugggaacaccagacuuuguggguaagauccaaggucugcucacucaaaccacaagagcagacggcucgacucgugcccacaaagccacagugagcacugggagcguucacuucaccccaaagcuggguaguguccaauucaccaccgacacaaacaaugacuuucaaacuggccaaaauacaaaauucaccccaguuggugucauccaagauggugaucaccaccagaaugaaccccaacaaugggugcucccaaauuacucaggcaccucuggucacaaugugcaucuggccccugccguugcucccacuuuccccggugagcagcuucuuuucuuuagguccaccaugcccgggugcagcggguacccuaacaugaauuuggauugccugcucccacaggagugggugucgcacuucuaucaggaagcagccccagcacaaucagauguggcccugcugagauuugugaauccagauacagguaggguuuuguuugagugcaaacuccauaaaucaggcuacaucacaguggcucacacugguccguaugauuugguuauuccccccaaugguuauuucagauuugauucuugggucaaccaguuuuacacacuugcccccaugggaaauggaucggggcgcaagcguguguaa

SEQ ID NO: 7704 - RNA, 1617 nt, Artificial Sequence
  VP1__Norovirus_and/or_Norovirus-like__GQ413969
augaagauggcgucgaaugacgccaacccaucugauggguccacagccaaccucgucccagaggucaacaaugagguuauggcuuuggagcccguuguaggugccgcuauugcggcaccuguagcgggccaacaaaauguaauugaccccuggauuagaaauaauuuuguacaagccccugguggagaguuuacaguguccccuagaaacgcuccaggugagauacuauggagugcgcccuugggcccugauuugaacccuuaccuuucucauuuggccagaauguacaaugguuaugcaggugguuuugaggugcagguaauccuugcggggaacgcguucaccgccgggaaaaucauauuugcagcagucccaccaaacuuuccaacugaaggcuugagccccagccagguuacuauguucccccacauaauaguggauguuaggcaauuggaaccuguguuaauccccuuaccugauguuaggaacaauuucuaucacuacaaccaaucaaaugacccuaccaucaaauugauagcaaugcuguacacaccacuuagggccaauaaugccggggaugaugucuucacagucucuugucgaguacucacgaggccauccccugauuuugauuucauauuucugguaccgccaacaguugaaucaagaaccaaaccauuuacugucccaaucuuaacuguugaggaaaugaccaauucaagauuccccauuccuuuggagagguuguacacgggccccagcagugcuuuuguuguccaaccacaaaacggcaggugcacgacugauggcgugcucuuaggcaccacccagcugucugcugucaacaucugcacuuuuagaggagauguuacucacauugcaggcucucgcaauuauacaaugaauuuggccucucaaaauuggagcaacuaugacccaacagaagaaaucccagccccccuggggaccccagauuuugugggaaagauccaaggcaugcucacccaaaccacaggaagagauggcucgacccgcggccacaaagccacagugcucacugggagugccgacuuugccccaaaauugggcaggguccaauucgccacugacacagacaacgauuucgagucuggcgaaaacacgaaauucaccccagucggcgucauccaggaugguuccaccacccaccggaaugaaccccaacaaugggugcucccaaauuacucagguagaacuggucauaaugugcaucuagccccugccguugcccccacuuacccgggugagcaacuccuuuucuucaggucuacuaugcccggaugcagcggguaucccaacauggauuuggauugccuacucccccaggagugggugcggcacuucuaccaagaggcagcuccggcacaaucugacguggcucuauugagauuugugaauccagacacgggcagaguccuguuugagugcaaacuucauaaaccaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7705 - RNA, 1617 nt, Artificial Sequence
  VP1__Norovirus_and/or_Norovirus-like__EU839592
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugagggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggagaaauuguucacgggucccaguagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaaggugugcucacucaaaccacaaagggagauggcucgacccguggccauaaagcuacagcuuacacugggagugcccccuuuacuccaaagcugggcaguguucaauucaguacugauacagaaaaugauuuugaaacucaccaaaacacaaaauucgccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7706 - RNA, 1617 nt, Artificial Sequence
  VP1__Norovirus_and/or_Norovirus-like__EU839587
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguuuacaguauccccuagaaacgcuccaggugaaauacuauggagcgcgcccuuaggcccugaucugaauccauaccuuucucaccuggccagaauguacaaugguuaugcaggugguuuugaagugcaaguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaucauuauaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacugucgaggaaaugaccaauucaagauuccccaucccuuuggaaaaauuguucacgggucccagcagugccuuugucguccaaccacaaaauggcaggugcacuacugauggcgugcucuuaggcacuacccaacugucccccgucaacaucugcaccuucagaggcgaugucacccacauuccagguacucgugcuuacagaaugaauuuggcuucucaaaauuggaacaauuaugacccaacagaagaaaucccagccccucugggaacuccagauuucgugggaaagauccagggcaugcucacccaaaccacaaagggagacggcucgacccgcggucacaaagcuacagugagcacugggaguguugacuucacuccaaagcugggcagcguucaguucgccacugauacagacaaugauuuugaaacuggccaaaacacaagguucaccccagucggugucauccaggaugguaguaguacccacagaaaugaaccccaacaauggguacuuccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggccagcaugauuugguaauuccccccaauggcuacuuuagauuugauuccugggucaaccaguucuacacacuugcccccaugggaaauggagcggggcguagacguuaa

SEQ ID NO: 7707 - RNA, 1617 nt, Artificial Sequence
  VP1__Norovirus_and/or_Norovirus-like__EU839583
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacucagagcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuugggcacuacccagcugucccccgucaacaucugcaccuucagaggcgaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggccacaaagcuacagugagcacugggaguguugacuuuacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuugcugagauuuguaaauccagacacagguaggguucuguuugagugcaagcuucauaaagcaggcuaugucacaguggcucacacuggccagcaugauuugguuauuccccccaauggcuacuuuagauuugauuccugggucaaccaguucuacacacuugcccccaugggaaauggagcggggcguagacguuaa

SEQ ID NO: 7708 - RNA, 1617 nt, Artificial Sequence
  VP1__Norovirus_and/or_Norovirus-like__AB303931
augaagauggcgucgaaugacgccaacccaucugauggguccgcagccaaccucgucccagaggucaacaaugagguuauggcuuuggagcccguuguuggugccgcuauugcggcaccuguagcgggccaacaaaacguaauugaccccuggauuagaaauaauuuuguacaagccccugguggagaguuuacaguauccccuagaaacgcuccaggugaaauacuauggagcgcgccuuugggcccugaucugaaucccuaccuuucucacuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuauaaccaaucaaaugacuccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauucccuuggaaaaguuguuuacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggauggcaauggugcccaccaaaaugaaccccagcaaugggugcucccaagcuacucagguagaacuggucacaaugugcaccuagcccccgccguagcccccacuuuuccaggugagcaacuucuuuucuucagguccacuaugcccggaugcagcggguaccccaacaugaauuuggauugucuacucccccaggaaugggugcagcacuucuaccaagaggcagcaccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugacuccugggucaaccaauucuacacacuugcccccaugggaaaugggacggggcguagacguuaa

SEQ ID NO: 7709 - RNA, 1617 nt, Artificial Sequence
  VP1__Norovirus_and/or_Norovirus-like__KY341923
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcagguggcuuugaagugcagguaauucucgcggggaaugcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaacaauuucuaucauuacaaucaaucaaaugacccuaccauuaaauugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucuuucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacucauaucacagguagucguaacuacacaaugaauuuggcuucucaaaauuggaacaauuaugacccaacagaagaaaucccagccccucuaggaacuccagauuuuguggggaagauccaaggcgugcucacccaaaccacaaggacagauggcucaacacgcggccacaaagcuacaguguauacugggagcgccgauuuugcuccaaaacuggguagaguucaauuugaaacugacacagaccaugauuuugaagcuaaccaaaacacaaaguucaccccaguuggugucauccaagaugguagcaccacccaccgaaacgaaccccaacagugggugcucccaaguuacucaggcagaaauacuccuaaugugcauuuggcccccgcuguggcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccuggguaaaccaguuuuacacgcuugcccccaugggaaauggaacggggcguagacguuaa

SEQ ID NO: 7710 - RNA, 1617 nt, Artificial Sequence
  VP1__Norovirus_and/or_Norovirus-like__KX514317
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcaggugcacgauugauggcgagcucuuaggcaccacccaacugucuucuguuaacauuugcaccuucagaggggaugucacccacccuagggacucuaaaauuuacacaaugaauuuggccucuccaaauuggaacaauuaugacccaacagaagagaucccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 7711 - RNA, 1617 nt, Artificial Sequence
  VP1__Norovirus_and/or_Norovirus-like__KU678204
augaagauggcgucgagugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaguaauuuuguacaagccccugguggagaguuuacaguuuccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugauguauucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggagaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaacacuccuaaugugcaccuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugacguggcucuguuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcgcagacguuaa

SEQ ID NO: 7712 - RNA, 1617 nt, Artificial Sequence
  VP1__Norovirus_and/or_Norovirus-like__KX158283
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuugggaccugaucuaaaucccuaccuaucccauuuagccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaacuagaaccuguguugauucccuuacccgauguuaggaauaauuuuuaucauuauaaucaaucaaaugaccccaccauuaaguugauagcaauguuguauacuccacucagggcuaacaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuacccauuccuuuggaaaggcuguucacgggucccagcagugccuuuguuguucaaccacaaaacggcaggugcacgacugauggcgugcuccuaggcacuacccaacuguccccugucaacaucugcaccuucagaggagaugucacccacaucacagguagucauaacuacacaaugaauuuggcuucucaaaauuggaacaauuaugacccaacagaagaaaucccagccccccuaggaacuccagacuuuguagggaagauucaaggcgugcucacccaaaccacaaggacagauggcucaacacgcggccacaaagccacaguguacacugggagcgccgaauuugcuccaaaacuggguagaguccaauuugaaacugacacaaaccaugauuuugaggcuaaccaaaacacaaaguucaccccagucggugucauccaagaugguagcaccacccaccgaaaugaaccccaacagugggugcucccaaguuacucaggcagaaacacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauauuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7713 - RNA, 1617 nt, Artificial Sequence
  VP1__Norovirus_and/or_Norovirus-like__KX354088
augaagauggcgucgaaugacgccaacccaucugauggguccgcagccaaccucgucccagaggucaacaaugagguuauggcuuuggaacccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucacuuggccaggauguauaaugguuaugcaggugguuuugaagugcaagugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucauuauaaucagucaaaugauucuaccauuaaauugauagcaaugcuguacacaccacuuagggccaacaaugccggggaugaugucuucacagucucuugucgaguccucacgaggccauccccugauuuugacuucauauuuuuagugccaccuacaguugagucaagaacuaagcuauuuacugucccaaucuugacuguugaagaaaugaccaauucaagauuccccauuccuuuggaaaaauuguucacgggucccagcagugccuuuguuguucaaccacaaaauggcagaugcacgacugauggcgugcuuuuaggcaccacccaacugucuccugucaacaucugcaccuucagaggggaugucacccacauugcgggcucucguaauuacacaaugaauuuggccucucuaaauuggaacaauuaugacccaacagaagaaauuccagccccucugggaacuccagauuucgugggaaagauccaaggugugcucacucaaaccacaaagggagauggcucgacccggggccauaaagcuacaguuuacacugggagugccgacuuuacuccaaagcugggcaguguucaauuugcuacugauacagaaaaugauuuugaaacucaccaaaacacaagauucaccccagucggugucauccaggaugguggcaccacccaccgaaaugaaccccaacaaugggugcucccaagcuauucagguagaaauguccauaauguacaccuagccccugcuguagcccccaauuuuccgggugaacaacuucuuuucuucagguccacuaugccuggaugcagcggguaucccaacauggauuuggauugccuacucccccaggagugggugcaacauuucuaucaagaggcagcuccagcacaaucugauguggcucuauugagauuugugaauccagacacggguaggguccuguuugagugcaaacuucauaaaucaggcuaugucacaguggcucauaccggccaauaugauuuggucaucccccccaauggcuauuuuagguuugauuccuggguuaaucaauucuauacacuugcccccaugggaaauggaacggggcguagacguuaa

SEQ ID NO: 7714 - RNA, 1617 nt, Artificial Sequence
  VP1__Norovirus_and/or_Norovirus-like__KX354032
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagcccuagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaauguuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacagaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggucacaaagccacaguguacacugggagcgccgacuuugcuccaaaacuggguagaguucaauuugaaacugacacagaccaugauuuugaagcuaaccaaaacacaaaguucaccccagucggugucauccaagaugguagcacuacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaggaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuacuuuagauuugauuccugggucaaccaguucuacacgcuugcccccaugggaaauggagcggggcguagacguuaa

SEQ ID NO: 7715 - RNA, 1617 nt, Artificial Sequence
  VP1__Norovirus_and/or_Norovirus-like__KX354015
augaagauggcgucgagugacgccagcccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacagaacggcaggugcacgacugauggugugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcgugcucacccaaaccacaaggacagauggcucaacacgcggucacaaagccacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggauugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggagcggggcguagacguuaa

SEQ ID NO: 7716 - RNA, 1617 nt, Artificial Sequence
  VP1__Norovirus_and/or_Norovirus-like__KX353999
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaggugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccacuauaaucaaucaaaugaucccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauucuaacuguugaggagaugaccaauucaagguuccccauuccuuuggaaaaguuguucacgggucccaguagugccuuuguuguucaaccacaaaacggcaggugcacgacugauggcgugcuccuagguaccacucaacugucuccugucaacaucugcaccuucagaggggacgucacccauauuucaggcagucguaacuacacaaugaauuuggccucccaaaauuggaacaguuacgauccaacagaagaaaucccagccccucuaggaacuccagauuucguggggaagauucaaggugugcucacucaaaccacaaguacagauggcucgacccgcggccacaaagcuacaguguacacugggagcgccgacuuuucuccaaaauuggguagaguucaauuugccacugacacagacaaugauuuugaaacuaaccaaaacacaaaauucaccccagucggcguuauccaggauggugguacuacccaccgaaaugaaccccaacaaugggugcucccaaguuacucaggcagaaacauucacaaugugcaccuggcccccgcuguagccccuacuuucccgggcgagcagcuccucuucuucagaucuacuaugcccggaugcagcggguaccccaacauggacuuggauugucugcucccccaggaaugggugcaguacuucuaccaggaggcagccccagcacagucugauguggcucuguuaagauuugugaauccagacacagguaggguuuuguuugaguguaagcuucauaaaucaggcuauguuacaguggcucauacuggccaacaugauuugguuaucccccccaaugguuacuuuagauuugauuccuggguaaaccaguucuacacacuugcccccaugggaaaugggacggggcguagacguuaa

SEQ ID NO: 7717 - RNA, 1617 nt, Artificial Sequence
  VP1__Norovirus_and/or_Norovirus-like__KX353987
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcacccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagucaggucacuauguucccccacauaauaguagauguuaggcaauuggaaccuguguugauucccuuacccgauguuaggaauaauuucuaccauuauaaucaaucaaaugacuccaccaucaaauugauagcaauguuguacacaccacuuagggcuaauaaugccggggacgaugucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcagaugcacgacugauggcgugcuccuagguacuacccaacugucuccugucaacaucugcaccuucagaggggaugucacccacauuucaggcagucauaacuacacaaugaauuuggcuucccaaaauuggaacaguuacgauccaacagaagaaaucccagccccucuaggaacuccagauuucguggggaagauucaaggugugcucacccaaaccacaaagacgaauggcucgacccgcggccacaaagccacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacccauaauguacaccuggcccccgcuguagcccccacuuucccgggcgagcagcuccucuucuucaggucuacuaugcccggaugcagcggguaccccaacauggaucuggacugucugcucccccaggagugggugcaguauuucuaccaggaggcagccccagcacaaucugacguggcucuguuaagauuugugaauccagauacagguaggguuuuguuugaguguaagcuucauaaaucaggcuacgucacaguggcccacacuggccaacaugauuugguuaucccccccaaugguuauuuuagauuugacuccugggucaaccaguucuacacacuugcccccaugggaaaugggacggggcguagacguuaa

SEQ ID NO: 7718 - RNA, 1617 nt, Artificial Sequence
  VP1__Norovirus_and/or_Norovirus-like__KX353970
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauucccuuacccgauguuaggaauaauuucuaucauuauaaucaaucaaaugaccccaccaucaaauugauagcaauguuguacacaccacucagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcaacaguguacacugggagcgccgacuuuucuccaaaacuggguagaguucaauuugccacugacacagacaaugauuuugaaacuaaccaaaacacaaaguucacuccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuuuuucagauccacuaugccuggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuucauaaaucaggcuauguuacaguggcucacacuggccaauaugauuugguuaucccucccaauggcuauuuuagauuugauuccugggucaaccaguucuacacacuugcccccaugggaaaugggacggggcguagacguuaa

SEQ ID NO: 7719 - RNA, 1617 nt, Artificial Sequence
  VP1__Norovirus_and/or_Norovirus-like__KU985156
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaagguuauauuugcagcagucccaccaaauuuuccaacugaaggcuugagccccagccaggucacuauguucccccauauagugguagauguuaggcaacuagaaccuguguugauucccuuacccgauguuaggaauaauuucuaucauuauaaucaaucaaaugaccccaccauuaaauugauagcaauguuguauacaccacuuagggcuaauaaugcuggggaugaugucuuuacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggcuucucagaacuggaacaauuaugacccaacagaagaaaucccagccccucuaggaacuccagacuuuguggggaagauucaaggcgugcucacccaaaccacaaggacagauggcucaacacguggccacaaagccacaguguacacugggagcgccgacuuugcuccaaaacuggguagaguucaauuugaaacugacacggaccaugauuuugaagcuaaccaaaacacaaaguucaccccagucggugucauccaagaugguggcaccacccaccgaaaugaaccccaacagugggugcucccaaguuacucaggcagaaauacucauaaugugcaccuggcccccgcuguagcccccacuuuuccgggugagcaacuucucuucuucagauccaccaugcccggaugcagcggguaccccaacauggauuuggacugucugcucccccaagaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuucagauuugauuccugggucaaccaguucuacacgcuugcccccaugggaaauggaacggggcguagacguuaa

SEQ ID NO: 7720 - RNA, 1617 nt, Artificial Sequence
  VP1__Norovirus_and/or_Norovirus-like__KU985155
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgcugggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuuuuaucauuauaaucaaucaaaugaccccaccauuaaauugauagcaauguuguauacaccacuuagggcuaauaaugcuggggaugaugucuuuacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggccucucagaauuggaacaauuaugacccaacagaagaaaucccagccccucuaggaacuccagacuuuguggggaagauucaaggcgugcucacccaaaccacaaggacagauggcucaacacgcggccacaaagccacaguguacacagggagcgccgacuuugcuccaaaacuggguagaguucaauuugaaacugacacggaccaugauuuugaaguuaaccaaaacacaaaguucaccccagucggugucauccaagaugguggcaccacccaccgaaaugaaccccaacagugggugcucccaaguuacucaggcagaaauacucauaaugugcaccuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuauuugaguguaagcuucauaaaccaggcuauguuacaguggcucacacuggccaacaugauuugguuaucccccccaaugguuauuucagauuugauuccugggucaaccaguucuacacgcuugcccccaugggaaauggaacggggcguagacguuaa

SEQ ID NO: 7721 - RNA, 1617 nt, Artificial Sequence
  VP1__Norovirus_and/or_Norovirus-like__KM514075
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaauugauagcaauguuguauacaccacuuagggcuaauaaugcuggggaugacgucuucacaguuucuugccgaguucucacgagaccaucccccgauuuugauuucauauuucuagugccacccacaguugagucaagaacuaaaccauucuccgucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacaggcagucauaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguucuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7722 - RNA, 1617 nt, Artificial Sequence
  VP1__Norovirus_and/or_Norovirus-like__AB972484
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagagauacucauaaugugcaucuggcccccgcuguagcccccacuuuuccgggugagcaacuucucuucuucagauccaccaugcccggaugcagcggguaccccaacauggauuuggacugucugcucccucaggaaugggugcaguacuucuaccaagaggcagccccagcacaaucugauguggcccugcuaagauuugugaauccagacacagguaggguuuuguucgaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7723 - RNA, 1617 nt, Artificial Sequence
  VP1__Norovirus_and/or_Norovirus-like__KT780391
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuuucuccaaaacuggguagaguucaauuugaaacugauacagaccaugauuuugaagcuaaccaaaacacaaaguucaccccaguuggugucauccaagaugguggcaccacccaccgaaaugaaccccaacagugggugcucccaaguuacucaggcagaaauacucccaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguaggcguuaa

SEQ ID NO: 7724 - RNA, 1617 nt, Artificial Sequence
  VP1__Norovirus_and/or_Norovirus-like__KT780390
augaagauggcgucgagugacgccaacccaucugauggguccgcagccaaccucgucccagaggucaauaaugagguuauggcucuggagcccguugucggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaccuaaaucccuaccuaucccauuuggccagaauguacaaugguuaugcaggugguuuugaagugcagguaauccucgcggggaacgcguucaccgccgggaaggucauauuugcagcagucccaccaaauuucccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggugugcuccuaggcaccacccaacugucuccugucaacaucugcaccuucagaggagaugucacccacaccacagguagucauaacuacacaaugaauuuggcuucucaaaauuggagcaauuaugacccaacagaagaaaucccagccccucuaggaacuccagauuuuguugggaagauucaaggcgugcucacccaaaccacaaggacagauggcucaacacgcggccacaaagccacaguguacacugggagcgccgacuuugcuccaaaacuggguagaguucaauuugaaacugacacagaccaugaucuugaagcuaaccaaaacacaaaguucaccccaguuggugucauccaagaugguggcgccacccaccgaaaugaaccccaacagugggugcucccaaguuacucaggcagaaacacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacguuaa

SEQ ID NO: 7725 - RNA, 1617 nt, Artificial Sequence
  VP1__Norovirus_and/or_Norovirus-like__KT780376
augaagauggcgucgagugacgccaacccaucugauggguccgcagccaaccucgucccagaggucaacaaugagguuuuggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgccccugggcccugaucuaaaccccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuuccugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaagcuguucacgggucccagcagugccuuuguuguccaaccacaaaacggcaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucagggcgugcucacccaaaccacaaggacagauggcucaacacgcggccacaaagccacaguguacacugggagcgccgacuuugcuccaaaacuggguagaguucaauuugaaacugacacaaaccaugauuuugaagcuaaccaaaacacaaaauucaccccaguuggugucauccaagaugguagcaccacccaccgaaaugaaccccaacagugggugcucccaaguuacucaggcagaaauacucccaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcggccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacguuaa

SEQ ID NO: 7726 - RNA, 1617 nt, Artificial Sequence
  VP1__Norovirus_and/or_Norovirus-like__KT780375
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuaggaacaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagaugucaggcaacuagaaccuguguugauucccuuacccgauguuaggaauaauuucuaucauuacaaucagucaaaugaccccaccauuaaauugauagcaauguuguauacaccacuuagggcuaauaaugcuggggaugaugucuucacaguuucuugccggguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagauaucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaucaugauuuugaagcuaaccaaaacacaaaguucaccccaguuggugucauccaagaugguagcaccacccaccgaaaugaaccccaacagugggugcuuccaaguuacucaggcagaaacacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguuuuacacgcuugcccccaugggaaauggaacggggcguagacguuaa

SEQ ID NO: 7727 - RNA, 1617 nt, Artificial Sequence
  VP1__Norovirus_and/or_Norovirus-like__LC016607
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaaacacucauacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucaccacugauacagacaaugauuuugaaacuggccaaaacacaagguucaccccagucggugucauccaggaugguaauggugcccacagaaaugaaccccaacaauggguacucccagauuacucagguggaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 7728 - RNA, 1617 nt, Artificial Sequence
  VP1__Norovirus_and/or_Norovirus-like__KP241915
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccucauauaguaguggauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuuccugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucagggcgugcucacccaaaccacaagggcagauggcucaacacgcggccacaaagccacaguguacacugggagcgccgacuuugcuccaaaacuggguagaguucaauuugaaacugacacaaaccaugauuuugaagcuaaccaaaacacaaaguucaccccaguuggugucauccaagaugguggcaccacccaccgaaaugaaccccaacagugggugcucccaaguuacucaggcagaaauacucccaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaucaagaggcggccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacguuaa

SEQ ID NO: 7729 - RNA, 1617 nt, Artificial Sequence
  VP1__Norovirus_and/or_Norovirus-like__KM514065
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccggcuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuuuagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7730 - RNA, 1617 nt, Artificial Sequence
  VP1__Norovirus_and/or_Norovirus-like__KM268097
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccaucuggccagaauguacaacgguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgaugucaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccagucuuaacuguugaggagaugaccaauucaagauuccccauuccuuuggaaaagcuguucacgggucccagcagugccuuuguuguccaaccacaaaacggcaggugcacgacugauggcgugcuccuaggcaccacccaacugucuccugucaacaucugcaccuucagaggagaugucacccauaucacaggcagucauaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacaaaccaugauuuugaagcuaaccaaaacacaaaauucaccccaguuggugucauccaagacgguggcaccacccaccgaaaugaaccccaacagugggugcucccaaguuacucaggcagaaauacuccuaaugugcaucuggcccccgcuguagcccccaccuuuccgggugagcaacuucucuucuucagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7731 - RNA, 1617 nt, Artificial Sequence
  VP1__Norovirus_and/or_Norovirus-like__KM268084
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucgcgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccagucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaagacagauggcucaacacgcggccauaaagccacaguguacacugggagcgccgacuuugcuccaaaacuggguagaguucaauuugaaacugacacagaccaugauuuugaagcuaaucaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7732 - RNA, 1617 nt, Artificial Sequence
  VP1__Norovirus_and/or_Norovirus-like__KJ649704
augaagauggcgucgagugacgccaacccaucugauggguccgcagccaaccucgucccagaggucaacaaugagguuuuggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugaucuaaaucccuaccuaucccauuuggcuagaauguacaaugguuaugcaggugguuuugaagugcagguaauucucgcggggaaugcguucaccgccgggaaggucauauuugcagcagucccaccaaauuuuccaacugaaggcuugagccccagccaggucacuauguuuccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggaugaugucuuuacaguuucuugccgaguucucacgagaccaucccccgauuuugauuuuauauuucuagugccacccacaguugagucaaggacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuauacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuuucuccaaaacuggguagaauucaauuugaaacugacacaaaccaugauuuugaagcuaaccaaaacacaaaguucaccccaguuggugucauccaagaugguggcaccacccaccgaaaugaaccccaacagugggugcucccaaguuacucgggcagaaauacuccuaaugugcaucuggcccccgcuguggcccccacuuuuccgggugagcaacuucucuuuuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucagguuauguuacaguggcucacacuggucaacaugauuugguuaucccccccaaugguuauuuuagguuugauuccugggucaaucaguuuuacacgcuugcccccaugggaaauggaacggggcguagacguuaa

SEQ ID NO: 7733 - RNA, 1617 nt, Artificial Sequence
  VP1__Norovirus_and/or_Norovirus-like__KC577174
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaacucaagguuccccauuccuuuggaaaaauuguucacgggccccaguagugccuuugucguucaaccacaaaacggcaggugcacgacugauggcgugcuccuagguaccacccaacugucuccugucaacaucugcaccuucagaggggaugucacccauauuucaggcaguaguaacuacacaaugaauuuggccucccaaaauuggaacaguuacgauccaacagaagaaauuccagccccucuaggaacuccagauuucguggggaagauucaagguguacucacccaaaccacaaggacagauggcucgacccgcggccacaaagcuacaguguacacugggagcgccgacuucucuccaaaacuggguagaguucaauuugccacugacacagacaaugauuuugaaacuaaccaaaacacaaaguucaccccagucgguguuauccaggauggugcuacuacccaccgaaaugaaccccaacaaugggugcucccaaguuacucaggcagaaacacucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaagucaggcuauguuacaguggcucacacuggccaacaugauuugguuaucccccccaaugguuauuuuagauuugauuccugggucaaccaguucuauacacuugcccccaugggaaaugggacggggcguagacguuaa

SEQ ID NO: 7734 - RNA, 1617 nt, Artificial Sequence
  VP1__Norovirus_and/or_Norovirus-like__KF177451
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagacaaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugaucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauccccccuaaugguuauuuuagguuugauuccugggucaaccaguuuuacacgcuugcccccaugggaaauggaacggggcguagacguuaa

SEQ ID NO: 7735 - RNA, 1617 nt, Artificial Sequence
  VP1__Norovirus_and/or_Norovirus-like__KF177429
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacucuggccaacaugauuugguuaucccccccaaugguuauuuuagguuugauuccugggucaaccaguuuuacacgcuugcccccaugggaaauggaacggggcguagacguuaa

SEQ ID NO: 7736 - RNA, 1617 nt, Artificial Sequence
  VP1__Norovirus_and/or_Norovirus-like__KF060005
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcagguggcuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccaccaucaaauugauagcaauguuguacacaccacuuagggcuaacaaugccggggacgauguuuucacaguuucuugucgaguucucacgagaccaucccccgauuuugauuucauauuuuuggugccacccacaguugaaucaagaacuaaaccauucucugucccaguuuuaacuguugaggagaugacuaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagagaucccagccccccugggaacuccagauuucguggggaagauucaaggcgugcucacccaaaccacaaggacagauggcucgacccgcggccacaaagcuacaguguacacugggagcgccgacuuuacuccaaaacuggguaggguucaauuugccacugacacagacaaugauuuuguaacuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcgcuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7737 - RNA, 1617 nt, Artificial Sequence
  VP1__Norovirus_and/or_Norovirus-like__JX439821
augaagauggcgucgagugacgccaacccaucugaugggucuacagccaaccucgucccagaggucaacaaugagguuauggcuuuggagcccguaguuggugccgccauugcggcaccuguagcgggccaacaaaauguaauugaccccuggauuagaaacaauuucguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccacauaauaguagauguuaggcaacuggaaccuguguugauccccuuacccgauguuaggaauaauuucuaucacuacaaucaaucaaaugaccccaccaucaaauugauagccauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuucaagcagucguaacuacacaaugaauuuggccucccaaaauuggagcaguuacgauccaacagaagaaaucccagccccucuaggaacuccagauuucguggggaagauucaagguguacucacccaaaccacaaggacagauggcucgacccgcggccacaaagcuacaguguacacugggagcgccgacuuuucuccaaaacuggguagaguucaauuugacacugacacagacaaugauuuugaaacuaaccaaaacacaaaguucaccccagucgguguuauccaggaugguaguacuaccuaccgaaaugaaccccaacaaugggugcucccaaguuacucaggcagaaacacucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaacccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacguuaa

SEQ ID NO: 7738 - RNA, 1617 nt, Artificial Sequence
  VP1__Norovirus_and/or_Norovirus-like__KC517361
augaagauggcgucgagugacgccaacccaucugauggguccgcagccaaccucgucccagaggucaacaaugagguuauggcucuggagcccguuguuggugccgccauugcggcaccuguggcgggccaacaaaauguaauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuucccauuccuuuggaaaaguuguucacgggucccagcagugccuuuguuguccaaccacaaaacggcaggugcacgacugauggcgugcuccuaggcaccacccaacugucuccugucaacaucugcaccuucagaggagauaucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacagugcacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccagcagugggugcucccaaguuacucaggcagaaacacucauaaugugcaucuggcccccgcuguagcccccacuuuuccgggugagcaacuucucuucuucagguccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7739 - RNA, 1617 nt, Artificial Sequence
  VP1__Norovirus_and/or_Norovirus-like__KC175378
augaagauggcgucgaaugacgccaacccaucugauggguccgcagccaaccucgucccagaggucagcaaugagguuauggcuuuggagcccguugucggugccgccauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuacuuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacuguuccaaucuuaaccguugaagaaaugaccaauucaagauuccccauuccuuuggaaaaguuguucacgggccccagcggugccuuuguuguccaaccacaaaauggcaggugcacgacugauggcgugcucuuaggcaccacccaacuaucuccugucaacaucugcaccuucagaggggaugucacccacauugcagguucucguaauuacacaaugaguuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacacuuagccccugcuguggcccccacuuucccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcucgcccccaugggaaacggaacggggcguaggcgcuaa

SEQ ID NO: 7740 - RNA, 1617 nt, Artificial Sequence
  VP1__Norovirus_and/or_Norovirus-like__JX459648
augaagauggcgucgaaugacgccaacccaucugaaggguccgcagccaaccucgucccagaggucaacaaugagguuauggcuuuggagcccguugucggugccgcuauugcggcaccuguagcgggccaacaaaauguaauugaccccuggauuagaaauaauuuuguacaagccccugggggggaguucacaguauccccuagaaacgcuccaggcacgauacgauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccugaugucaggaauaacuucuaucauuauaaucagucaaaugauucuaccauaaaauugauagcaauguuguauacaccacuuagggcuaauaaugcuggggaagaugucuucacagucucuugucgaguccucacgaggccaucccccgauuuugauuuuauauuuuuggugccacccacaguugagucaagaacuaaaccauuuacugucccaaucuuaacuguugaagaaaugacuaauucgagauucuccauuccuuuggaaaaguuguucacgggucccagcggugccuuuguuguucaaccacaaaauggcagaugcacgacugauggcgugcuccuaggcaccacccaacugucuccugucaacaucugcaccuucagaggggaugucacccacauugcagguucucguaacuacacaaugaauuuggcugcucuaaauuggaacaauuaugacccaacagaagaaauuccugccccucuaggaacuccagauuucguggggaagauccaaggugugcucacucaaaccacaaagggagauggcucgacccguggccauaaagcuacaguuuacacugggagugccgacuucacuccaaagcugggcaguguucaauucaguacugauacagaaaaugauuuugaaucucaccaaaacacaaaauucaccccagucggcgucauccaggaugguagcaccacccaucgaaaugaaccccaacaaugggugcucccaaguuauucagguagaaauguccauaauguacaccuagccccugccguggcccccacuuuuccgggugaacaacuucuuuucuucagguccacuaugcccggaugcagcggguaucccaacauggauuuggauugccuaaucccccaagagugggugcagcacuucuaccaagaggcagcuccagcacaaucugauguggcucuauugagauuugugaauccagacacggguaggguccuguuugagugcaaacuccauaaaucaggcuaugucacaguggcucacaccggucagcaugauuuggucaucccccccaauggcuacuuuagguuugauuccuggguuaaucaauucuacacacuugcccccaugggaaauggagcggggcguagacguuaa

SEQ ID NO: 7741 - RNA, 1617 nt, Artificial Sequence
  VP1__Norovirus_and/or_Norovirus-like__JX459635
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuacuuaucucauuuggccagaauguauaauggcuaugcaggugguuuugaagugcaggugauccucgcggggaacgcguucaccgccgggaaaauuauauuugcagcagucccaccaaauuuuccaacugaaggcuugagccccagucaggucacuauguucccccacauaauacuagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccgccgaaaugaaccccaacaaugggugcucccaaguuauucagguagaaaugcccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7742 - RNA, 1617 nt, Artificial Sequence
  VP1__Norovirus_and/or_Norovirus-like__JX459624
augaagauggcgucgaaugacgcccacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaccuccagauuucgugggaaagauccaaggugugcuuacucaaaccacaaagggggauggcucgacucguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7743 - RNA, 1617 nt, Artificial Sequence
  VP1__Norovirus_and/or_Norovirus-like__JX459614
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacggguccuagcggugccuuuguuguucaaccacaaaauggcagaugcacgacugauggcgugcucuuagguaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaauaugauguggcucuauugagauuugugaauccagacacggguaggguccuguuugagugcaaacuucauaaaucaggcuaugucacaguggcucacaccggccagcaugauuugguuaucccccccaauggcuauuuuagguuugauuccuggguuaaucaauucuacacacuugcccccauggguaauggaacggggcguagacguuaa

SEQ ID NO: 7744 - RNA, 1617 nt, Artificial Sequence
  VP1__Norovirus_and/or_Norovirus-like__HM635103
augaagauggcgucgagugacgccaacccaucugauggguccacagccaaccucgucccagaggucaacaaugagguuauggcuuuggagcccguaguuggugccgccauugcggcaccuguagcgggccaacaaaacguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucuguuccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugaucuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucagguuauguuacaguggcucacacuggccagcaugauuugguuaucccccccaaugguuauuuuagauuugauuccugggucaaccaguucuacacacuugcccccaugggaaaugggacggggcguagacguuaa

SEQ ID NO: 7745 - RNA, 1617 nt, Artificial Sequence
  VP1__Norovirus_and/or_Norovirus-like__JQ613522
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggucugagucccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggccaauaaugcuggggaagaugucuucacagucucuugucgaguccucacgagaccauccccugauuuugauuuuauauuuuuggugccacccacaguugagucaagaacuaaaccauuuacugucccaaucuuaacuguugaagaaaugaccaauucaagauuccccauuccauuggaaaaguuguucacgggucccagcggcgccuuuguuguccaaccacaaaauggcaggugcacgacugauggcgugcucuuaggcaccacccaacuguccccugucaacaucugcaccuucagaggggaugucacccacauugcagguucucgugauuacacaaugaauuuggcaucucuaaauuggaacaauuaugacccaacagaagaaauuccagccccucugggaacuccagauuucgugggaaagauccaagguaugcucacucaaaccacaaagggagauggcucgacccguggccauaaagcuacaguuuacacugggagugcccccuuuacuccaaagcugggcaguguucgauucaguacugauacagaaaaugauuuugaaacucaccaaaacacaaaauucaccccagucggugucauccaggaugguagcaccacccaccgaaaugaaccccaacaaugggugcucccaaguuauucagguagagacguccauaauguacaccuagccccugcuguagcccccacuuuuccgggugaacaacuucuauucuucagguccacuaugcccggaugcaguggguaucccaacauggauuuggauugccuacucccccaggagugggugcagcacuucuaccaagaggcagcuccagcacaaucugauguggcccuauugagauuugugaauccagauacggguaggguccuguuugagugcaaacuucauaaaucaggcuaugucacaguggcucacaccggccagcaugauuugguuaucccccccaaugguuauuuuagguuugauuccugggucaaucaauucuacacacuugcccccaugggaaauggaacggggcguagacguuaa

SEQ ID NO: 7746 - RNA, 1617 nt, Artificial Sequence
  VP1__Norovirus_and/or_Norovirus-like__AB629942
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuucauauucuuggugccaccuacaguugagucaagaacuaaaccauuuacugucccaaucuuaacuguugaagaaaugaccaacucaagauuccccauuccuuuggagaaguuguucacaggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguucaauucaguacugauacacaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucauaaaucacgcuaugucacaguggcucacaccggucagcaugauuuggucaucccccccaaugguuauuuuagguuugacuccuggguuaaucaauucuacacgcuugcccccaugggaaauggaacggggcguagacguuaa

SEQ ID NO: 7747 - RNA, 1617 nt, Artificial Sequence
  VP1__Norovirus_and/or_Norovirus-like__GQ856457
augaagauggcgucgaaugacgccaacccaucugaugggcccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccauauaauaguggauguuaggcaauuggaaccuguguugauccccuuaccugauguuaggaauaauuucuaucacuauaaucagucaaaugauucuaccauuaaauugauagcaaugcuauauacaccacuuagggcuaauaaugcuggggaagaugucuucacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccuguuaacaucugcaccuucagaggggaugucacccacauugcagguucuaguaauuacacaaugaauuuggcuucucuaaauuggaacaauuaugacccaacagaagaaauuccagccccucuaggaacuccagauuuugugggaaagauccaaggugugcucacccaaaccacaaagggagaugguucgacccguggccauaaagcuacaguuuacacugggagugcccccuuuacuccaaaguugggcaguguucaguucaguacugauacacaaaaugauuuugaaacccaccaaaacacaaaauucaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagccccagcacaaucugauguggcucuauugagauuugugaauccagacacggguaggguccuguuugagugcaaacuucauaaaucacgcuaugucacaguagcucacaccggccagcaugauuuggucaucccccccaaugguuauuuuagguuugauuccuggguuaaccaauucuacacacuugcccccaugggaaauggaacggggcguagacguuaa

SEQ ID NO: 7748 - RNA, 1617 nt, Artificial Sequence
  VP1__Norovirus_and/or_Norovirus-like__EU876883
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccacuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguccccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgauguuuucacaguuucuugucgaguucucacgagaccaucccccgauuuugauuucauauuuuuagugccacccacaguugagucaagaaccaaaccauucucugucccaauuuuaacuguugaggagaugaccaauucaagauuccccauuccuuuggaaagguuguuuacgggucccagcagugccuuuguuguucaaccacaaaauggcaggugcacgacugauggcgugcuccuagguacuacccaacugucuccugucaacaucugcaccuucagaggggaugucacccacauugcaggcacucaagaauacacaaugaaucuggccucccaaaacuggaacaauuaugacccaacagaagaaaucccagccccucugggaacuccagauuucguggguaagauccaaggcgugcucacccaaacaacaaggagggauggcucgacccgcggucacaaagccacagugagcacuggaaguguccauuucaccccaaagcugggcagaauucaauucuccacugauacaagcaaugauuuugaaacuggccaaaacacgagauucaccccagucgguguuguccaggauggugguaccacccaccaaaaugaaccccaacaauggguacucccaaauuauucagguagagauggucacaaugugcaccuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccggacacagguaggguucuauuugaguguaagcuucauaaaucaggcuauguuacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7749 - RNA, 1617 nt, Artificial Sequence
  VP1__Norovirus_and/or_Norovirus-like__AB447455
augaagauggcgucgaaugacgccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucgcaauuacacaaugaauuuggcuucucuaaguuggaacaauuacgacccaacagaagaaauuccagccccucuaggaacuccagauuucgugggaaagauccaaggugugcucacucaaaccacaaagggggauggcucgacccguggccauaaagcuacaguuuacacuggaagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7750 - RNA, 1617 nt, Artificial Sequence
  VP1__Norovirus_and/or_Norovirus-like__EU078409
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaucaaucaaaugaccccaccauuaaauugauagcaaugcuguauacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggagaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuuugugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgagauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7751 - RNA, 1617 nt, Artificial Sequence
  VP1__Norovirus_and/or_Norovirus-like__AB303928
augaagauggcguccaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguauacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggagaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcacccucagaggggaugucacccacauugcagguacucauaauuacacaaugaauuuggcuucucaaaauuggaacaauuaugacccaacagaagaaaucccagccccucuggggaccccagauuucgugggaaggauccaaggcgugcucacccaaacuacaaggggggauggcucuacccgcggccacaaagcuacagugagcacuggggauguccacuucacuccaaagcugggcaguguucaguucaacacugacacaaacaaugauuuugaaauuggccaaaacacgagauucaccccagucgguguuguccaggaugguaauggcacccaccaaaaugaaccccaacaaugggugcuuccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcauuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuauuuuagauuugauuccugggucaaccaauucuacacacuugcccccaugggaaaugggacggggcguagacguuaa

SEQ ID NO: 7752 - RNA, 1617 nt, Artificial Sequence
  VP1__Norovirus_and/or_Norovirus-like__AY502023
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaauuaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7753 - RNA, 1617 nt, Artificial Sequence
  VP1__Norovirus_and/or_Norovirus-like__KU678202
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuugggcccugaucuaaaucccuacuuaucucauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuagacaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccgucccccgauuuugacuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuacgacccaacagaagaaaucccagccccucuagggacuccagacuuuguggggaagauucaaggcaugcuuacccaaaccacaaggacagauggcucaacacgcggccacaaagccacaguguacacugggagcgccgacuuugcuccaaaacuggguagaguucaauuugaaacugacacaaacaaugauuuugaagcuaaccaaaacacaaaguucaccccaguuggugucauccaagaugguggcaccacccaccgaaaugaaccccaacagugggugcucccaaguuacucaggcaggaacacuccuaaugugcaucuggcccccgcuguagcccccacuuuuccgggugagcaacuccucuucuucagauccaccaugcccggaugcagcggguaccccaacauggauuuggauugucugcucccccaggaaugggugcaguacuucuaccaagaggcagccccagcacaaucugauguggcucugcuaagauuugugaauccagacacagguaggguuuuguuugaauguaagcuucauaaaucaggcuauguuacaguggcucacacuggccaacaugauuugguuaucccccccaaugguuauuuuagguuugauuccugggucaaccaguuuuacacgcuugcccccaugggaaauggagcggggcguagacguuaa

SEQ ID NO: 7754 - RNA, 1617 nt, Artificial Sequence
  VP1__Norovirus_and/or_Norovirus-like__KX371607
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccagaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7755 - RNA, 1617 nt, Artificial Sequence
  VP1__Norovirus_and/or_Norovirus-like__KX354112
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguuuccccuagaaacgcuccaggugaaauacuauggagcgcgcccuugggaccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacaaaaccauucucugucccaguuuuaacuguugaggagaugaccaauucaagauuccccauuccuuuggaaaagcuguucacgggucccagcagugccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaucccagccccucuaggaacuccagacuuuguggggaagauucaaggcgugcucacccaaaccacaagaacagauggcucaacacgcggccacaaagccacaguguacacugggagcgccgacuuugcuccaaaauuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaacacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaucaagaggcagccccagcacaaucugauguggcucugcuaagauuugugaauccagacacagguaggguuuuguuugaguguaagcuucauaaaucaggcuauguuacaguggcucacauuggccaacaugauuugguuauuccccccaaugguuauuuuagauuugauuccugggucaaccaguucuacacgcucgcccccaugggaaauggaacggggcguagacguuaa

SEQ ID NO: 7756 - RNA, 1617 nt, Artificial Sequence
  VP1__Norovirus_and/or_Norovirus-like__KX353993
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaguccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaacaacuucuaccauuauaaucaaucaaaugaccccacuaucaaauugauagcaauguuguacacaccacuuagggcuaauaaugccggggacgaugucuucacaguuucuugccgaguucucacgagaccaucccccgauuuugauuucauauuucuggugccacccacaguugaaucaagaacuaaaccauucucugucccaguuuuaacuguugaggagaugaccaauucaagguuccccauuccuuuggaaaaguuguucacgggccccaguagugccuuuguuguacaaccacaaaauggcaggugcacgacugauggcgugcuccuaggcaccacccaacuguccccugucaacaucugcaccuucagaggugaugucacccauauuccaggcagucguaacuacacaaugaauuuggccucccaaaauuggaacaguuacgacccaacagaagaaauuccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugagacuaaccaaaacacaaaguucaccccagucgguguuauccaggauggugccaccaccccccgaaaugaaccccaacaaugggugcucccaaguuacucaggcagaaauauccacaaugugcaccuggcccccgcuguagcccccacuuucccgggcgagcagcuccucuucuucaggucuacuaugcccggaugcagcggguaccccaacauggauuuggacugucugcucccccaggaaugggugcaguauuucuaccaagaggcagccccagcacaaucugauguggcucuuuuaagauuugugaauccagacacagguaggguuuuguuugaguguaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacguuaa

SEQ ID NO: 7757 - RNA, 1617 nt, Artificial Sequence
  VP1__Norovirus_and/or_Norovirus-like__KR131762
augaagauggcgucgagugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguuaauccccuuaccugauguuaggaauaauuucuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggucauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuuuccgggugagcaacuucuuuucuucagguccacuaugcccggaugcagcggguaucccaacauggauuuggauugccugcucccccaggagugggugcagcacuucuaccaagaggcggcuccagcacaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacguuaa

SEQ ID NO: 7758 - RNA, 1617 nt, Artificial Sequence
  VP1__Norovirus_and/or_Norovirus-like__AB972519
augaagauggcgucgagugacgccaacccaucugauggguccgcagccaaccucgucccagaggucaacaaugagguuauggcucuggagcccguuguuggugccgccauugcggcaccuguagcgggccagcaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaagcuuauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggcgucauccaagaugguggcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7759 - RNA, 1617 nt, Artificial Sequence
  VP1__Norovirus_and/or_Norovirus-like__AB972498
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugaucuaaaucccuaccuaucccauuuagcuagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggaauuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7760 - RNA, 1617 nt, Artificial Sequence
  VP1__Norovirus_and/or_Norovirus-like__AB972488
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaaccccagauuuuguggggaagauucaaggcgugcucacccaaaccacaaggacagauggcucaacacgcggccacaaagccacaguguacacugggagcgccgacuuuguuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7761 - RNA, 1617 nt, Artificial Sequence
  VP1__Norovirus_and/or_Norovirus-like__AB972483
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaaucuuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgauuuugcuccaaaacuggguagaguucaauuugaaacugacacagaccaugacuuugaaacuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuucagguuugauuccugggucaaccaguuuuacacgcuugcccccaugggaaauggaacggggcguagacguuaa

SEQ ID NO: 7762 - RNA, 1617 nt, Artificial Sequence
  VP1__Norovirus_and/or_Norovirus-like__KP864106
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguugauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugauccaacagaagaaaucccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcagcuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaauguaagcuucauaaaucaggcuauguuacaguggcucacacuggccaacaugauuugguuaucccccccaaugguuauuuuagguuugauuccugggucaaccaguuuuacacgcuugcccccaugggaaacggaacggggcguagacgguaa

SEQ ID NO: 7763 - RNA, 1617 nt, Artificial Sequence
  VP1__Norovirus_and/or_Norovirus-like__KR904216
augaagauggcgucgagugacgccaacccaucugauggguccacagccaaccucgccccagaggucaacaaugagguuauggcuuuggagcccguaguuggugccgcuauugcggcaccuguagcgggccaaaaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguuuaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacagucucuugucgaguucucacgagaccaucccccgauuuugauuucauauuuuuggugccacccacaguugaaucaagaacuaaaccauucucugccccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuucaggcagucguaacuacacaaugaauuuggccucccaaaauuggaacaguuacgauccaacagaagaaaucccagcuccucuaggaacuccagauuucguggggaagauccaaggugugcucacccagaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacacucauaaugugcaccuggcccccgcuguagcccccacuuucccgggcgagcagcuccucuuuuucagaucuacuaugcccggaugcagcggguaccccaacauggauuuggacugucugcucccccaggaaugggugcaguauuucuaccaggaggcagccccagcacaaucugauguggcucuguuaagguuugugaauccagacacagguaggguuuuguuugaguguaagcuucauaaaucaggcuauguuacaguggcucacacuggccaacgugauuugguuaucccccccaaugguuauuuuagauuugauuccugggucaaccaguucuacucacuugcccccaugggaaaugggacggggcgccggcguuaa

SEQ ID NO: 7764 - RNA, 1617 nt, Artificial Sequence
  VP1__Norovirus_and/or_Norovirus-like__AB933771
augaagauggcgucuagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaucuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccagguuacuauguucccccacauaauaguagauguuaggcaauuggaaccuguguugauccccuuacccgauguuaggaauaauuucuaccauuauaaucaaucaaaugaccccacuaucaaauugauagcaauguuguacacaccacuuagggcuaauaaugcuggggacgacgucuucacaguuucuugucgaguccucacgagaccuucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuacaggcagucguaacuacacaaugaauuuggccucccaaaauuggaacaguuacgacccaacagaagaaaucccagccccucuaggaacuccagauuucguggggaagauccaaggugugcucacccaaaccacaaggacaaauggcucgacccgcggccacaaagcuacaguguacacugggagcgccgacuuuucuccaaaacuggguagaguucaauuugccacugacacagacaacgauuuugaagcuaaccaaaacacaaaguucaccccagucgguguuauccaggaugguaguaccaccccccgaaacgaaccccaacagugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcccacacuggccaacaugauuugguuaucccccccaaugguuauuuuagauuugauuccugggucaaccaguucuacacacuugcccccaugggaaaugggacggggcguagacguuaa

SEQ ID NO: 7765 - RNA, 1617 nt, Artificial Sequence
  VP1__Norovirus_and/or_Norovirus-like__LC005732
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgacguuaggaauaauuucuaucauuacaaucaaucaaaugaucccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacggguagucguaacuacacaaugaauuuggcuucucaaaauuggaacaauuaugacccaacagaagaaaucccagccccuuuaggaacuccagauuuuguggggaagauucaaggcgugcucacccaaaccacaaggacagauggcucaacacguggccacaaagcuacaguguacacugggagcgccgauuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuaugcuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7766 - RNA, 1617 nt, Artificial Sequence
  VP1__Norovirus_and/or_Norovirus-like__KP293591
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcagguggcuuugaagugcagguaauucucgcggggaaugcguucaccgccgggaaggucauauuugcagcagucccaccaaauuuuccaacugaaggcuugagccccagucaggucacuauguucccccauauaguaguagauguuaggcaacuagaaccuguguugauucccuuacccgauguuaggaauaauuucuaucauuacaaucaaucaaaugacccuaccauuaaauugauagcaauguuguauacaccacuuagggcuaauaaugcuggggaugaugucuucacaguuucuugcagaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcaugcucacccaaaccacaagggcagauggcucaacacgcggccacaaagcuacaguguauacugggagcgccaacuuugcuccaaaacuggguagaguucaauuugaaacugacacagaccaugauuuugaagcuaaccaaaacacaaaguucaccccaguuggugucauccaagaugguagcaccacccaccgaaacgaaccccaacagugggugcucccaaguuauucaggcagaaauacuccuaaugugcauuuggcccccgcuguggcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauuccuggguaaaccaguuuuacacgcuugcccccaugggaaauggaacggggcguagacguuaa

SEQ ID NO: 7767 - RNA, 1617 nt, Artificial Sequence
  VP1__Norovirus_and/or_Norovirus-like__KP176396
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaauugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacaggcagucgaaacuacacaaugaauuuggcuucucaaaauuggaacaauuaugacccaacagaagaaaucccagccccucuagggacuccagauuuuguggggaagauucaaggcgugcucacccaaaccacaaggacagauggcucaacacgcggccacaaagcuacaguguacacugggagcgccgauuucucuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuauuuuagguuugauuccugggucaaccaguuuuacacgcuugcccccaugggaaauggaacggggcguaggcguuaa

SEQ ID NO: 7768 - RNA, 1617 nt, Artificial Sequence
  VP1__Norovirus_and/or_Norovirus-like__KP176394
augaagauggcgucgagugacgccaacccaucugauggguccgcagccaaccucgucccagaggucaacaaugagguuauggcucuggagcccguuguuggugccgccauugcggcaccuguagcgggccagcaaaaugugauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauccucgcggggaacgcguucaccgccgggaaggucauauuugcagcagucccaccaaauuuuccaacugaaggcuugagccccagccaggucacuauguucccccauauaguaguagauguuaggcaacuagaaccuguguuaauucccuuacccgauguuaggaauaauuucuaucacuacaaucaaucaaaugaccccaccauuaaguugauagcaauguuguauacaccacuuagggccaauaaugcuggggaugauguuuucacaguuucuugccgaguucucacgagaccaucccccgauuuugauuucauauuucuagugccacccacaguugagucaagaacuaaaccauucucugucccagucuuaacuguugaagagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaauuacacaaugaauuuggcuucucaaaauuggagcaauuaugacccagcagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagauggcggcaccacccaccgaaaugaaccccaacagugggugcucccaaguuacucaggcagaaauacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcugagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7769 - RNA, 1617 nt, Artificial Sequence
  VP1__Norovirus_and/or_Norovirus-like__KP096348
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaaccgaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacagucgagucaagaacuaaaccauucucugucccaguuuuaacuguugaggagaugaccaacucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuacgacccaacagaagaaaucccagccccucuaggaacuccagacuuuguggggaagauucaaggcgugcuuacccaaaccacaaggacagauggcucaacacgcggccacaaagccacaguguacacugggagcgccgacuuugcuccaaagcuggguagaguucaauuugaaacugacacaaaccaugauuuugaugcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaauguaagcuucauaaaucaggcuaugucacaguggcucacacuggccaacaugauuugguuaucccccccaaugguuauuuuagguuugauuccugggucaaccaauuuuacacgcuugcccccaugggaaauggaacggggcgcagacguuaa

SEQ ID NO: 7770 - RNA, 1617 nt, Artificial Sequence
  VP1__Norovirus_and/or_Norovirus-like__KP096344
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgcugggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaguuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauucgaaacugacacagaccaugauuuugaagcuaaccaaaacacaaaguucaccccaguuggugucauccaagaugguagcaccacccaccgaaaugaaccucaacagugggugcucccaaguuacucaggcagaaauacuccuaaugugcaucuggcccccgcuguagcucccacuuuuccgggugagcaacuucucuucuucagauccaccaugcccggaugcagcggguaccccaauauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7771 - RNA, 1617 nt, Artificial Sequence
  VP1__Norovirus_and/or_Norovirus-like__KM982946
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuuuauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccgugauuuugaaacuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7772 - RNA, 1617 nt, Artificial Sequence
  VP1__Norovirus_and/or_Norovirus-like__KM514070
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaacuagaaccuguguugauucccuuacccgacguuaggaauaauuucuaucauuauaaucaaucaaaugaccccaccauuaaguugauagcaauguuguauacaccacuuagggcuaauaaugcuggggaugaugucuucacaguuucuugccgaguucuuacgaggccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccaugucacagguagucguaacuacacaaugaauuuggcuucucaaaauuggagcaauuaugacccaacagaagaaaucccagccccucuaggaacuccagacuuuguggggaagauucaaggcgugcucacccaaacuacaaggacagauggcucaacacgcggccacaaagccacaguguacacugggagcgcuaacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7773 - RNA, 1617 nt, Artificial Sequence
  VP1__Norovirus_and/or_Norovirus-like__KM514061
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagauaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7774 - RNA, 1617 nt, Artificial Sequence
  VP1__Norovirus_and/or_Norovirus-like__KM514060
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacaggcagucgaaacuacacaaugaauuuggcuucucaaaauuggaacaauuaugacccaacagaagaaaucccagccccucuagggacuccagauuuuguggggaagauucaaggcgugcucacccaaaccacaaggacagauggcucaacacgcggccacaaagcuacaguguacacugggagcgccgauuuuucuccaaaacuggguagaguucaauuugaaacugauacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugccugcucccccaggaaugggugcaguacuucuaccaagaggcagccccagcacaaucugauguggcucugcuaagauuugugaauccagacacagguaggguuuuguuugaguguaagcuccauaaaucaggcuauguuacaguggcucacacuggccaacaugauuugguuaucccccccaaugguuauuuuagguuugauuccugggucaaccaguuuuacacgcuugcccccaugggaaauggagcggggcguaggcguuaa

SEQ ID NO: 7775 - RNA, 1617 nt, Artificial Sequence
  VP1__Norovirus_and/or_Norovirus-like__KM268079
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuuccugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucagggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacguuaa

SEQ ID NO: 7776 - RNA, 1617 nt, Artificial Sequence
  VP1__Norovirus_and/or_Norovirus-like__KJ710247
augaagauggcgucgaaugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuauugaggagaugaccaauucaagauuccccauuccuuuggaaaaguuguucacgggccccagcagugccuuuguuguucaaccacaaaacggcaggugcacgacugauggcgugcuccuaggcaccacucaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguaggguucaauuugaaacugacacagaccaugauuuugaagcuaaccaaaacacaaaguucaccccaaucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccaaugguuacuuuagguuugauuccugggucaaccaguucuacacgcuugcccccaugggaaauggaacggggcgcaggcgauaa

SEQ ID NO: 7777 - RNA, 1617 nt, Artificial Sequence
  VP1__Norovirus_and/or_Norovirus-like__KJ685405
augaagauggcgucgagugacgccaacccaucugauggguccacagccaaccucgucccagaggucaacaaugagguuauggcuuuggagcccgugguuggugccgcaauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagacaauccucgcggggaacgcguucaccgccgggaaaaucauauuugcagcagucccaccaaauuucccaacugaagguuugagccccagccagguuacuauguucccccacauaauaguagauguuaggcaauuggaaccuguguugauucccuuacccgauguuagaaauaauuucuaccauuacaaccaaacaaaugaccccaccaucaaauugauagcaauguuguacacaccacuuagggcuaauaaugccggggacgaugucuucacagucucuugucgaguucucacaagaccaucccccgauuuugauuucauauuuuuggugccacccacaguugaaucaagaacuaaaccauucucugucccgguuuugacuguugaggagaugaccaauucaagguuccccauuccuuuggagaaauuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguagaguucaauuugccacugauacagacaaugauuuugaaacuaaccaaaauacaaaguucaccccagucgguguuauccaggauggugguacuacccaccgaaaugaaccccaacaaugggugcucccaaguuacucaggcagaaacacucauaaugugcaccuggcccccgcuguagcccccacuuucccgggcgagcagcuccucuuuuucagaucuacuaugcccggaugcagcggguaccccaacauggauuuggacugucugcucccccaggaaugggugcaguauuuuuaccaggaggcagccccagcacaaucugauguggcucuguuaagauuugugaauccagauacagguaggguccuguuugaguguaaacuucauaaaucaggcuauguuacaguggcucacacuggccaacaugauuugguuaucccccccaaugguuauuuuagauuugacuccugggucaaccaguucuauacacuugcccccaugggaaaugggacggggcguagacguuaa

SEQ ID NO: 7778 - RNA, 1617 nt, Artificial Sequence
  VP1__Norovirus_and/or_Norovirus-like__KF429766
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguguccccuagaaacgcuccaggugagauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccacuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacagcuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaauuaaccaaaacacaaaguucaccccagucgguguuauccaggaugguaguacuaccccccgaaaugaaccccaacaaugggugcucccaaguuacucaggcagaaacacucacaaugugcaccuggcccccgcuguagcccccacuuucccgggcgagcaacuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaacccagauacagguagggucuuguuugaguguaagcuucauaaaucaggcuauguuacaguggcucacacuggccaacaugauuuaguuaucccccccaaugguuauuuuagguuugauuccugggucaaccaguucuacacacuugcccccaugggaaaugggacggggcguagacguuaa

SEQ ID NO: 7779 - RNA, 1617 nt, Artificial Sequence
  VP1__Norovirus_and/or_Norovirus-like__KF060009
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaauuccagccccucuaggaacuccagauuuuguggggaagauucaaggcgugcucacccaaaccacaaggacagauggcucaacacgcggccacaaagcuacaguguacacugggagcgccgacuuugccccaaaacuggguagaguucaauuugaaacugacacagaccaugauuuugaugcuaaccaaaacacaaaguucaccccagucggugucauccaagaugguggcaccacccaccgaaaugaaccccaacagugggugcucccaaguuacucaggcagaaacacucauaaugugcaucuggcucccgcuguagcccccacuuuuccgggugagcaacuucucuucuucagauccaccaugcccggaugcagcggguaccccaacauggauuuggacuguuugcucccccaggaaugggugcaguacuucuaccaggaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacguuaa

SEQ ID NO: 7780 - RNA, 1617 nt, Artificial Sequence
  VP1__Norovirus_and/or_Norovirus-like__KF059996
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuaggaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuagacaauuggaaccuguguugaucccuuuacccgauguuaggaauaauuucuaccacuauaaucaaucaaaugaccccacuaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguuuacgggcccuaguagugccuuuguuguucaaccacaaaacggcaggugcacgacugauggcgugcuccuaggcaccacccaacuguccccagucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaacaacaaagacaaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguaccaccccucgaaaugaaccccaacaaugggugcucccaaguuacucaggcagaaacauucauaaugugcaccuggcccccgcuguggcccccacuuucccgggcgagcagcuccucuucuucagaucuacuaugcccgggugcagcggguaccccaacauggauuuggacugccugcucccccaggagugggugcaguacuucuaccaggaggcagccccagcacaaucugacguggcuuuguuaagauuugugaauccagacacagguaggguuuuguuugaguguaagcuucauaaaucaggcuauguuacaguggcucacacuggccaacaugauuugguuaucccccccaaugguuacuuuagauuugauuccugggucaaccaguucuacacacuugcccccaugggaaaugggacggggcguagacguuaa

SEQ ID NO: 7781 - RNA, 1617 nt, Artificial Sequence
  VP1__Norovirus_and/or_Norovirus-like__HF952130
augaagauggcgucgagugacgccaacccaucugauggguccacagccaaccucgucccagaggucaacaaugagguuauggcuuuggagcccguaguuggugccgccauugcagcaccuguagcgggccaacaaaauguaauugaccccuggauuagaagcaauuuuguacaagccccugguggagaguuuacaguauccccuagaaacgcuccaggugaaauacuauggagcgcacccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagucaggucacuauguucccccacauaauaguagauguuaggcaauuggaaccuguguugauucccuuacccgauguuaggaauaauuucuaccauuauaaucaaucaaaugacuccaccaucaaauugauagcaauguuguacacaccacuuagggcuaauaaugccggggacgaugucuucacaguuucuugucgaguccucacgagaccaucccccgauuuugauuucauauuuuuggugccacccacaguugaaucaagaacuaaaccguucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucuccugucaacaucugcaccuucagaggggaugucacccacauuucaggcagucguaacuacacaaugaauuuggcuucccaaaauuggaacaguuacgauccaacagaagaaaucccagccccucuaggaacuccagauuucguggggaagauucaaggugugcucacccaaaccacaaagacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauucaggaugguaguacuaccccccgaaaugaaccccaacaaugggugcucccaaguuacucaggcagaaacacccauaauguacaccuggcccccgcuguagcccccacuuucccgggcgagcagcuccucuucuucagaucuacuaugcccggaugcagcggguaccccaacauggaucuggacugucugcucccccaggagugggugcaguauuucuaucaggaggcagccccagcacaaucugacguggcucuguuaagauuugugaacccagauacagguaggguuuuguuugaguguaagcuucauaaaucaggcuauguuacaguggcucacacuggucaacaugauuugguuaucccccccaaugguuauuuuagauuugacuccugggucaaccaguucuacacacuugcccccaugggaaaugggacggggcguagacguuaa

SEQ ID NO: 7782 - RNA, 1617 nt, Artificial Sequence
  VP1__Norovirus_and/or_Norovirus-like__KC409302
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagccguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaauuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7783 - RNA, 1617 nt, Artificial Sequence
  VP1__Norovirus_and/or_Norovirus-like__JX459908
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugacccuaccauuaaguugauagcaauguuguauacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggcuucucaaaauuggaacgauuaugacccaacagaagaaaucccagccccucuaggaacuccagauuuuguggggaagauucaaggcguucucacccaaaccacaaggacagauggcucaacacgcggccacaaagcuacaguguacacugggagcgccgacuuugcuccaaaacuggguagaguucaauuugaaacugacacagaccgugauuuugaagcuaaccaaaacacaaaguucaccccagucggugucauccaagaugguggcaccacccaccgaaaugaaccccaacagugggugcucccaagcuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7784 - RNA, 1617 nt, Artificial Sequence
  VP1__Norovirus_and/or_Norovirus-like__JX445166
augaagauggcgucgagugacgccaacccaucugauggguccacagccaaccuugucccagaggucaacaaugagguuauggcuuuggagcccguaguuggugccgccauugcggcaccuguggcgggccaacaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaccaaucaaaugaccccaccaucaaauugauagcaauguuguacacaccacuuagggcuaauaaugccggggacgaugucuucacaguuucuugucgaguucucacgaggccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucacaacuacacaaugaauuuggccucccaaaauuggaauaguuacgauccaacagaagaaaucccagccccucuaggaacuccagauuucguggggaagauucaaggugugcucacccaaaccacaaggacaaauggcucgacccgcggccacaaagccacaguguacacugggagcgccgacuuuucuccaaaacuggguagaguucaauuugccacugacacaaacaaugauuuugaaacuaaccaaaacacaaaguucaccccagucgguguuauccaggaugguaguaccaccccccgaaaugaaccccaacaaugggugcucccaaguuauucaggcagaaacacucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagguuugugaauccagacacagguaggguuuuguuugaguguaagcuucauaaaucaggcuauguuacaguggcucacacuggccaacaugauuugguuaucccucccaaugguuauuucagauuugauuccugggucaaccaguucuacacacuugcccccaugggaaaugggacggggcguagacguuaa

SEQ ID NO: 7785 - RNA, 1617 nt, Artificial Sequence
  VP1__Norovirus_and/or_Norovirus-like__HQ693090
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucgcaguauccccuagaaacgcuccaggugaaauacuauggagcgcgcccuuaggcccugaucugaaucccuaccuaucucauuuggccagaauguauaaugguuaugcagguggguuugaagugcaggugauccucgcggggaacgcguucaccgccggaaaaauuauauuugcagcagucccaccaaauuuuccaacugaaggcuugagccccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaucaaaacacaaaauucgccccagucggugucauccaggaugguagcaccacccaccgaaaugaaccccaacaaugggugcucccaaguuauucagguggaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguucgauuccuggguuaaucaauucuacacacuugcccccaugggaaauggaacggggcguagacguuaa

SEQ ID NO: 7786 - RNA, 1617 nt, Artificial Sequence
  VP1__Norovirus_and/or_Norovirus-like__JN400611
augaagauggcgucgaaugacgccaacccaucugauggguccgcagcuaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugaucccuuuaccugauguuaggaauaacuucuaucacuauaaucagucaaaugauuccaccauuaaauugauagcaaugcuguauacaccacucagggcuaauaaugcuggggaagaugucuucacagucucuugucgaguccucacgaggccauccccugauuuugaucuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgaccgauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagguuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7787 - RNA, 1617 nt, Artificial Sequence
  VP1__Norovirus_and/or_Norovirus-like__JN400609
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccgggaaaauuauauuugcagcagucccaccaaauuuuccaacugaaggcuugggccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggggugcccccuucacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagguuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7788 - RNA, 1617 nt, Artificial Sequence
  VP1__Norovirus_and/or_Norovirus-like__JQ613517
augaagauggcgucgagugacgccaacccaucugauggguccacagccaaccucgucccagaggucaacaaugagguuauggcuuuggagcccguuguuggagccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugacuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccagguuacuauguucccccauauaauaguagauguuaggcaacuggacccuguguugauccccuuacccgauguuaggaauaauuucuaucacuauaaucaaucaaaugaccccaccaucaaauugauagcaauguuguauacaccacuuagggcuaauaaugcuggggacgaugucuucacagucucuugucggguucucacgagaccaucccccgauuuugauuucauauuuuuagugccaccuacaguugagucaagaacuaaaccauucucugucccaauuuuaacuguugaggagaugaccaauucaagauuccccauuccuuuggaaaaguuguucacgggucccagcagugcuuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacacggggggauggcucgacccguggucacaaagccacagugagcacuggaaguguccacuucaccccaaagcugggcagaauucaauucuccacugauacaagcaaugauuuugaaacuggccaaaacacgagauucaccccaguugguguuguccaggaugguaguaccacccaccaaaaugaaccccaacaaugggugcucccaaauuauucagguagagauagucacaaugugcaccuagccccugcuguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagguuugauuccugggucaaccaauucuacacacuugcccccaugggaaauggaacggggcguagacguuaa

SEQ ID NO: 7789 - RNA, 1617 nt, Artificial Sequence
  VP1__Norovirus_and/or_Norovirus-like__JQ478409
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucaccauguucccccacauaauaguagauguuaggcaauuggaaccuguguugauccccuuaccugauguuaggaauaacuucuaccacuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccaguaggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucggauguggcucuauugagauuugugaauccagacacggguaggguccuguuugagugcaaacuucauaaaucaggcuaugucacaguggcucacaccggccagcaugauuuggucaucccccccaacggcuauuuuagguuugauuccuggguuaaucaauucuacacacuugcccccaugggaaauggaacgggggguagacguuaa

SEQ ID NO: 7790 - RNA, 1617 nt, Artificial Sequence
  VP1__Norovirus_and/or_Norovirus-like__GQ856460
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauucccuauuccuuuggaaaaauuguucacggaucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagacuucgugggaaagauccaaggugugcucacucaaaccacaaagggagauggcucgacccguggccauaaagcuacaguuuacacugggagugcccccuucacuccaaagcugggcaguguccaauucaguacugauacagaaaaugauuuugaaacucaccaaaacacaaaguucaccccagucggugucauccaggaugguggcaccacccaccgaaaugaaccccaacaaugggugcucccaaguuauucagguagaaaugucccuaauguacaccuagccccugcuguggcccccacuuuuccgggugaacaacuucuuuucuuuagguccacuaugcccggaugcagcggguaucccaacauggauuuggacugcccacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7791 - RNA, 1617 nt, Artificial Sequence
  VP1__Norovirus_and/or_Norovirus-like__GQ856449
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguuuccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuucuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguacucauaacuacacaaugaauuuggcuucucuaaauuggaacaauuacgacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccggucggugucauccaggaugguagcaccacccaccgaaaugaaccccaacaaugggugcucccaaguuauucagguggaaauguccaaaauguacaccuagccccugcuguagcccccacuuuuccgggugaacaacuucuuuucuuuagguccacuaugcccggaugcagcggguaucccaacauggauuuggauugccuacucccccaggagugggugcagcauuucuaccaagaggcagcuccagcacaaucugauguggcucuauugagauucgugaauccagacacggguaggguccuguuugagugcaaacuucauaaaucaggcuacgucacaguggcucacaccggccagcaugauuuggucaucccccccaaugguuauucuagguuugaucccuggguuaaucaauucuacacacuugcccccaugggaaauggaacggggcguagacguuaa

SEQ ID NO: 7792 - RNA, 1617 nt, Artificial Sequence
  VP1__Norovirus_and/or_Norovirus-like__EU921344
augaagauggcgucgagugacgccaccccaucugauggguccacagccaaccucgucccagaggucaacaaugagguuauggcuuuggagcccguuguuggugccgcgauugcagcaccuguagcgggccaacaaaauguaauugaccccuggauuagaaauaauuuuguacaagccccugguggagaguuuacaguauccccuagaaacgcuccaggugaaauauuauggagcgcgcccuugggcccugauuugaaucccuaccuuucccauuuggccagaauguacaauggauaugcaggugguuuugaagugcaggugauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucauuacaaucaaucaaaugaccccaccaucaaauugauagcaaugcuguauacaccacuuagggcuaacaaugcuggggacgaugucuucacagucucuugccgaguucucacgagaccaucccccgauuuugauuucauauuuuuggugccacccacaguugaaucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcaggcacucaaaauuacacaaugaaucuggccucccaaaauuggaacaacuacgacccaacagaagaaaucccagccccucugggaaccccagauuuuguaggaaagauccaaggcaugcccacccaaacuacaaggggggauggcucgacccgcggucauaaagccacagugagcacuggaaguguccacuucaccccaaagcugggcaguguucaauuuuccacugacacaagcaaugacuuugaaacuggccaaaacacgagauucaccccagucggugucguccaggaugguaguaccacccaccaaaaugaaccccaacaaugggugcucccaaacuauucagguagagacagucacaauguacaucuagccccugccguggcccccacuuuuccgggugagcaacuucuuuucuuuagguccacuaugcccggaugcagcggguaucccaacaugaauuuggauugccuacucccucaggagugggugcagcacuucuaccaagagucagcuccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaccaauucuacacacuugcccccaugggaaauggagcggggcguagacguuaa

SEQ ID NO: 7793 - RNA, 1617 nt, Artificial Sequence
  VP1__Norovirus_and/or_Norovirus-like__AB541290
augaagauggcgucgaaugacgccaacccaucugauggguccgcagccaaccucgucccagaggucaacaaugagguuauggcuuuggagcccguugucggugcugcuauugcggcgccuguagcgggccaacaaaauguaauugaccccuggauuagaaauaauuuuguacaagccccugguggagaguucacaguaucuccuaggaacgcuccaggugaaauacuauggagcgcucccuuaggcccugaucugaaucccuaccuaucucauuuggccagaauguauaaugguuaugcaggugguuuugaagugcaggugguccucgcggggaacgcguucaccgccggaaaaauuauauuugcagcagucccaccaaauuuuccaacugaaggcuugagccccagucaggucacuauguucccccacauaauaguagauguuaggcaauuggagcccguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaacucaagauucccuauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggaguacccccuuuacuccaaagcugggcaguguucaauucagcacugauacagaaaaugauuuugaaaaucaccaaaacacaaaauuuaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguauccuaacauggaucuggauugccuacucccccaggaguggguacagcacuucuaccaagaggcagcuccagcacaaucugauguggcucuacugagauuugugaauccagauacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7794 - RNA, 1617 nt, Artificial Sequence
  VP1__Norovirus_and/or_Norovirus-like__GQ845322
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguaucccccagaaacgcuccaggugaaauacuauggagcgcacccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccgucuccugauuuugauuuuauauuuuuggugccacccacaguugagucaagaacuaaaccauuuacugucccaaucuuaacuguugaagaaaugaccaauucaagauuccccauuccuuuggaaaaguuguuuacgggucccagcggugccuuuguuguccaaccacaaaauggcaggugcacgacugauggcgugcucuuaggcaccacccaacugucuccugucaacaucuguaccuucagaggggaugucacccacauugcagguucucguaauuacacaaugaauuuggcaucucuaaacuggaacaauuaugacccaacagaagaaauuccagccccucugggaacuccagauuucgugggaaagauccaaggugugcucacucaaaccacaaagggagauggcucgacccguggccauaaagcuacaguuuacacugggaguacccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuuuccgggugaacaacuucuuuucuucagguccacuaugcccggaugcagcggguaucccaacauggauuuggauugccuacucccccaggagugggugcaacacuucuaccaagaggcagcuccagcgcaaucugauguggcccuauugagauuugugaauccagacacggguaggguccuguuugagugcaaacuucauaaaucaggcuaugucacaguggcucacaccggccaacaugauuuggucaucccccccaauggcuauuuuagguuugauuccuggguuaaucaauucuacacacuugcccccaugggaaauggaacggggcguagacguuaa

SEQ ID NO: 7795 - RNA, 1617 nt, Artificial Sequence
  VP1__Norovirus_and/or_Norovirus-like__AB220921
augaagauggcgucgaaugacgccagcccaucugauggguccacagccaaccucgucccagaggucaacaaugagguuauggcuuuggagcccguuguuggugccgccauugcggcaccuguagcgggccaacaaaauguaauugaccccuggauuaggacuaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucaucuuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaacgacuccaccauuaaauugauagcaaugcuguacacaccacuuagggcuaauaaugcuggggaugaugucuucacagucucuugucgaguccucacgaggccaucccccgauuuugauuuuauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccagcugucccccgucaacaucugcaccuucagaggcgaugucauccacauuccagguacucguacuuacagaaugaauuuggcuucucaaaauuggaacaauuaugacccaacagaagaaaucccagccccucugggaaccccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucacaauguacaccuagccccugccguagcccccacuuuuccaggugagcaacuucuuuucuucagaucuacuaugcccggaugcaguggguaucccaauauggauuuggauugucuacucccccaggaaugggugcagcacuucuaccaagaggcagccccaucacaaucugauguggcuuugcugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacguuaa

SEQ ID NO: 7796 - RNA, 1617 nt, Artificial Sequence
  VP1__Norovirus_and/or_Norovirus-like__KX514221
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 7797 - RNA, 1617 nt, Artificial Sequence
  VP1__Norovirus_and/or_Norovirus-like__KY486271
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaacuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcacaacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcaugcucacccaaaccacaagggcagauggcucaacacgcggccacaaagccacaguguacacugggagcgccgacuuugcuccaaaacuggguagaguucaauuugagacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguacccuaacauggauuuggacugucugcucccccaggaaugggugcaguacuucuaccaagaggcagcccccgcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7798 - RNA, 1617 nt, Artificial Sequence
  VP1__Norovirus_and/or_Norovirus-like__KP784692
augaagauggcgucgagugacgccaacccaucugauggguccacagccaaccucgucccagaggucaacaaugagguuauggcuuuggagcccguuguuggugccgcccuugcggcaccuguagcgggccaacaaaauguaauugaccccuggauuagaagcaauuuuguacaagccccugguggagaguucacaguauccccuagaaacgcuccaggugaaauacuauggagcgcgcccuuaggccccgauuugaaccccuaccuuucucauuuggccagaauguacaaugguuaugcaggugguuuugaagugcaggugauccucgcggggaaugcguucaccgccggaaaagucauauuugcagcagucccaccaaauuucccaacugaaggcuugagccccagccaggucacuauguucccccacauaauaguagauguuaggcaauuggaaccuguguugaucccccuacccgauguuaggaauaauuucuaccacuacaaucaaucaaaugaauccaccaucaaauugauagcaauguuguauacaccacuuagggcuaacaaugcuggggacgaugucuucacagucucuugucgaguccucacgagaccaucccccgauuuugauuuuauauuuuuagugccacccacaguugagucaagaacuaaaccauucucugucccaauuuuaacuguugaggaaaugaccaauucaagauuccccauuccuuuggaaagguuguucacgggucccagcagugccuuugucguucaaccacaaaacggcaggugcacgacugauggcgugcuccuagguacuacucaacugucuccugucaacaucugcaccuucagaggagaugucacccacaccacagguagucacaacuacacaaugaauuuggcuucccaaaauuggagcaauuaugacccaacagaagaaaucccagccccucuaggaacuccagauuucguggggaagauucaaggugugcucacccaaaccacaagggcagauggcucgacccgcggccacaaagcuacaguguacacugggagcgccgacuuuacuccaaaacuggguagaguucaauuugccacugauacagaccaugauuuugauacuaaccaaaacacaaaguucaccccagucggugucauccaggaugguucuacuacccaccggaaugaaccccaacaaugggugcucccaaguuacucaggcaggaauacucauaaugugcaccuggcccccgcuguggcccccacuuuuccgggugaacagcuucucuucuuuagauccaccaugcccggauguaguggguaccccaacauggauuuggacugccugcucccccaagaauggguggcgcauuucuaccaggaggcagccccagcacaaucugauguggcucugcuaagauuugugaauccagauacaggcaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaauggaacggggcguagacguuaa

SEQ ID NO: 7799 - RNA, 1617 nt, Artificial Sequence
  VP1__Norovirus_and/or_Norovirus-like__KX371604
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccgggaaaaucguauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacaggccccaguagugccuuuguuguucaaccacaaaauggcaggugcacgacugauggcgugcuccuagguacuacccaacuguccccugucaacaucugcaccuuuagaggggaugucacccauauuucagguagucguaacuacacaaugaauuuggccucccaaaauuggaacaguuacgauccaacagaagaaaucccagccccucuagggacuccagauuucguggggaagauucagggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuauagcccccacuuucccgggcgagcagcuccucuucuucagaucuacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuccauaaaucaggcuauguuacaguggcucacacuggucaacaugauuugguuaucccccccaaugguuauuuuagguuugauuccugggucaaccaguucuacacacuugcccccaugggaaaugggacggggcguagacguuaa

SEQ ID NO: 7800 - RNA, 1617 nt, Artificial Sequence
  VP1__Norovirus_and/or_Norovirus-like__KX354079
augaagauggcgucgagugacgccaacccaucugauggguccacagccaaccuugucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugagauacuauggagcgcgcccuuagguccugauuugaaucccuaccuuucccauuuggccagaauguauaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccacuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuauacaaugaauuuggccucccaaaauuggaacaguuacgauccaacagaagaagucccagccccccuaggaacuccagauuucguggggaagauucaaggugugcucacccaaaccacaaggacagauggcucgacccgcggccacaaagcuacaguguacacugggagcgcagacuuuucuccaaaacuggguaggguucaauuugccacugacacagacaaugauuuuguagcuaaccaaaacacaaaguucacuccagucgguguuauccaggaugguagcacuaccccccgaaaugaaccccaacaaugggugcucccaaguuacucaggcagaaacacucauaaugugcaccuggcccccgcuguagcccccacuuucccaggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguagggucuuguuugaguguaagcuucauaaaucaggcuauguuacaguggcucacacuggccaacaugauuuaguuaucccccccaaugguuauuuuagauuugauuccugggucaaccaguucuacacacuugcccccaugggaagugggacggggcguagacguuaa

SEQ ID NO: 7801 - RNA, 1617 nt, Artificial Sequence
  VP1__Norovirus_and/or_Norovirus-like__KX354028
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggaccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaauuagaaccuguguugauucccuuacccgauguuaggaauaauuucuaucauuauaaucaaucaaaugaccccaccauuaaguugauagcaauguuguauacuccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaagcuguucacgggucccagcagcgccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaccccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaacacucauaaugugcaccuggcccccgcuguagcccccacuuuuccgggugagcaacuucucuucuucagauccaccaugcccggaugcagcggguaccccaacauggauuuggacugucugcucccccaggaaugggugcaguacuucuaccaggaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7802 - RNA, 1617 nt, Artificial Sequence
  VP1__Norovirus_and/or_Norovirus-like__KX353983
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuaggaacaauuuuguacaagccccugguggagaguuuacaguauccccuagaaacgcuccaggugaaauacuauggagcgcgcccuuaggcccugauuugaaucccuaucuuucccauuuggccagaauguacaaugguuaugcaggugguuuugaagugcagguaauccucgcggggaaugcguucaccgccgggaaaaucguauuugcagcagucccaccaaauuucccaaccgaagguuugagccccagccaagucacuauguucccccacauaauaguagauguuagacaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaguuguucacgggccccaguagugccuuuguuguucaaccacaaaacggcaggugcacgaccgauggcgugcuccuagguacuacccaacugucuccugucaacaucugcaccuucagaggggaugucacccacauuucaggcagucguaacuacacaaugaacuuggccucccaaaauuggaacaguuacgauccaacagaagaaaucccggccccccuaggaacuccagauuucguggggaagauucaaggugugcucacccaaaccacaaggacagauggcucgacccgcggccauaaagcuacaguguacacugggagcgccgacuuuucuccaaaacuggguaggguucaauuugccacugacacagacaaugauuuuguaacuaaccaaaacacaaaguucaccccagucgguguuauucaggaugguaguacuaccccccgaaaugaaccccaacaaugggugcucccaaguuacucaggcagaaacacucauaaugugcaccuggcccccgcuguagcccccacuuucccgggcgagcagcuccuauucuucagaucuaccaugcccgggugcagcggguaccccaacauggauuuggacugucugcucccccaggaaugggugcaguauuucuaccaggaagcagccccagcacaaucugauguggcacuguuaagauuugugaauccagacacagguaggguuuuguuugaguguaagcuccauaaaucagguuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7803 - RNA, 1617 nt, Artificial Sequence
  VP1__Norovirus_and/or_Norovirus-like__AB972511
augaagauggcgucgaaugacgccaacccaucugaugggcccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucaucuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuauacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccgaguuauucagguagaaaugucccuaauguacaccuagccccugcuguagcccccacuuuuccgggugaacaacuccuuuucuuuagguccauuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaagucaggcuaugucacaguggcccauaccggccagcaugauuuggucaucccccccaaugguuauuuuagguuugauuccuggguuaaccaauucuacacgcuugcccccaugggaaacggaacggggcguagacguuaa

SEQ ID NO: 7804 - RNA, 1617 nt, Artificial Sequence
  VP1__Norovirus_and/or_Norovirus-like__AB972478
augaagauggcgucgagugacgccaacccaacugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaaucuuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucaccagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7805 - RNA, 1617 nt, Artificial Sequence
  VP1__Norovirus_and/or_Norovirus-like__KT780382
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugagauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauagugguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgacuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugauccaacagaagaaaucccagccccucuaggaacuccagacuuuguggggaagauucaaggcgugcucacccaaaccacaaggacagaugguucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacaaugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcuuugcuaagauuugugaauccagacacggguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7806 - RNA, 1617 nt, Artificial Sequence
  VP1__Norovirus_and/or_Norovirus-like__KT033905
augaagauggcgucaaaugacgccaacccaucugauggguccgcagccaaccucgucccaaaggucaacaaugagguuauggcuuuggagcccguugucggugccgcuauugcggcgccuguagcgggccaacaaaauguaauugaccccuggauuagaaacaauuuuguacaagccccugguggaaaguucacaguauccccuagaaacgcuccaggugaaauacuauggagcgcgcccuuaggcccugaucugaaucccuaccuaucucauuuggccagaauguacaaugguuaugcaggugguuuugaagugcaggugauucucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguccaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuuuagguccacuaugcccggaugcagcggguaucccaacauggauuuggauugccuacucccccaagagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7807 - RNA, 1617 nt, Artificial Sequence
  VP1__Norovirus_and/or_Norovirus-like__KR904207
augaagauggcgucgagugacgccaacccaucugauggguccacagccaaccucgucccagaggucaacaaugagguuauggcuuuggagcccguuguuggugccgccauugcggcaccuguagcgggccaacaaaacguaauugaccccuggauuagaaacaauuuuguacaagccccugguggagaguuuacaguauccccuagaaacgcuccaggugaaauacuguggagcgcgcccuuaggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggccccaguaguaccuuuguuguucaaccacaaaacggcaggugcacgacugauggugugcuccuagguacuacccaacugucucccgucaacaucugcaccuucagaggggaugucacccauauugcaggcagccauaacuacacaaugaaucuggcuucccaaaauuggaacaguuaugacccaacagaagaaaucccagccccucuaggaacuccagauuucguggggaagauucaaggugugcucacccaaaccacaaggacggauggcucgacccgcggccacaaagcuacaguguacacugggagcgccgacucuucuccaaaacuggguagaguucaauuugccacugacacagacaaugauuuuguugcuaaccaaaacacaaaguucaccccagucgguguuauccaggauggugguacugcccaccgaaaugaaccccaacaaugggugcucccaagcuacucgggcagaaauacucauaaugugcaccuggcccccgcuguagcccccacuuuuccgggugagcagcuccucuuuuucaggucuaccaugcccggaugcagcggguaccccaacauggauuuggacugucugcucccccaggaaugggugcaguauuucuaccaggaggcagccccagcacaaucugauguggcucugcuaagauuugugaauccagacacagguaggguuuuguuugaguguaagcuccauaaaucaggcuauguuacacaggcucacacuggccaacaugauuuggucaucccccccaaugguuauuuuagauuugauuccugggucaaccaguucuacacacuugcccccaugggaaaugggacggggcgcaggcgauaa

SEQ ID NO: 7808 - RNA, 1617 nt, Artificial Sequence
  VP1__Norovirus_and/or_Norovirus-like__KJ678151
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7809 - RNA, 1617 nt, Artificial Sequence
  VP1__Norovirus_and/or_Norovirus-like__KJ678143
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7810 - RNA, 1617 nt, Artificial Sequence
  VP1__Norovirus_and/or_Norovirus-like__KP698927
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuaccugauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauuuucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuuggaacuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcccugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7811 - RNA, 1617 nt, Artificial Sequence
  VP1__Norovirus_and/or_Norovirus-like__LC005730
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaucuaucccauuuggccagaauguacaaugguuaugcaggugguuuugaagugcagguaauucucgcggggaacgcguucaccgcugggaaggucauauuugcagcagucccaccaaauuuuccaacugaaggcuugagccccagccaggucacuauguucccccauauagugguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcguacuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugcucccucaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7812 - RNA, 1617 nt, Artificial Sequence
  VP1__Norovirus_and/or_Norovirus-like__LC005714
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaaccacaaagggagaugguucgacccguggccauaaagcuacaguuuacacugggaguacccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7813 - RNA, 1617 nt, Artificial Sequence
  VP1__Norovirus_and/or_Norovirus-like__KP241906
augaagauggcgucgagugacgccaacccaucugauggguccgcagccaaccucgucccagaggucaacaaugagguuauggcucuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaagguuugagccccagccaggucacuauguuuccccauauaguaguagauguuaggcaacuagaaccuguguugauucccuuacccgauguuaggaauaauuucuaucauuacaaccaaucaaaugaccccaccauuaaauugauagcaauguuguacacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuuuagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccauaaagccacaguguacacugggagcgccaauuuugcuccaaaacuggguagaguccaauuugaaacugacacagaccaugauuuugaagccaaccaaaacacaaaguucaccccaguuggugucauccaagaugguggcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacuuccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcgcagacguuaa

SEQ ID NO: 7814 - RNA, 1617 nt, Artificial Sequence
  VP1__Norovirus_and/or_Norovirus-like__KM982938
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcuugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguagggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaccaguucuacacgcuugcccccaugggaaauggaacggggcguagacguuaa

SEQ ID NO: 7815 - RNA, 1617 nt, Artificial Sequence
  VP1__Norovirus_and/or_Norovirus-like__KM514058
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcaggcggcuuugaagugcagguaauucucgcggggaacgcguucaccgccgggaaagucauauuugcagcagucccaccaaauuuuccaacugaaggcuugagccccagccaggucacuauguuuccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcuugcuccuaggcaccacccaacugucuccugucaacaucugcaccuucagaggagaugucacccauauuacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccgugauuuugaagcuaaccaaaacacaaaguucaccccaguuggugucauccaagauggugguaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguuaa

SEQ ID NO: 7816 - RNA, 1617 nt, Artificial Sequence
  VP1__Norovirus_and/or_Norovirus-like__KM198580
augaagauggcgucgaaugacgccaacccaacugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaccccuaccuaucccauuuggccagaauguauaaugguuaugcaggugguuuugaagugcaggugauccucgcggggaacgcguucaccgccgggaaaauuauauuugcagcagucccaccaaauuuuccaacugaaggccugagucccagccaggucacuauguucccccacauaauaguagauguuaggcaauuagaaccuguguugauccccuuaccugauguuaggaauaacuucuaucacuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcacuacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacccaaaccacaaaaggagauggcucgacccguggccauaaagcuacaguuuacacugggagugcccccuuuaccccaaagcugggcaguguucaauucaguacugacacagaaaaugauuuugaaacucaccaaaacacaaaauucaccccagucggugucauccaggauggugguaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7817 - RNA, 1617 nt, Artificial Sequence
  VP1__Norovirus_and/or_Norovirus-like__KM198537
augaagauggcgccgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaauaauuuuguacaagccccugguggagaguucacaguauccccuagaaacgcuccaggugaaauacuauggggcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccucuggaaaaguuguucacgggucccagcggugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccaccaugcccggaugcagcggguaucccaacauggauuuggauugccuacucccccaggagugggugcagcacuucuaccaagaggcagcuccagcacaaucugauguggcucuacugagauuugugaauccagacacggguaggguccuguuugagugcaaacuucauaaaucagguuaugucacaguggcucacaacggucagcaugauuuggucaucccccccaauggcuauuuuagguuugauuccuggguuaaucaauucuacacacuugcccccaugggaaacggaacggggcguaggcgcuaa

SEQ ID NO: 7818 - RNA, 1617 nt, Artificial Sequence
  VP1__Norovirus_and/or_Norovirus-like__KF177450
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguccucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuucgcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugaucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7819 - RNA, 1617 nt, Artificial Sequence
  VP1__Norovirus_and/or_Norovirus-like__KF008243
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaaugcguucaccgcugggaaggucauauuugcagcagucccaccaaauuuuccaacugaaggcuugagccccagccaggucacuauguucccccauauagugguagauguuaggcaacuagaaccuguguugauucccuuacccgauguuaggaauaauuucuaucauuauaaucaaucaaaugaccccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggccucucaaaauuggaacaauuaugacccaacagaagaaaucccagccccucuaggaacuccagacuuuguggggaagauucaaggcgugcucacccaaaccacaaggacagauggcucaacacgcggccacaaagccacaguguacacugggaguaccgacuuugcuccaaaacuggguagaguucaauuugaaacugacacagaccaugacuuugaagcuaaccaaaacacaaaguucaccccagucggugucauccaagaugguagcaccacccaccgaaaugaaccccaacagugggugcucccaaguuacucaggcagaaauacucauaaugugcaucuggcccccgcuguagcccccacuuuuccgggugaacaacuucucuucuucagauccaccaugcccggaugcagcggguaccccaacauggauuuggacugucugcucccucaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7820 - RNA, 1617 nt, Artificial Sequence
  VP1__Norovirus_and/or_Norovirus-like__KF429782
augaagauggcgucgagugacgccaacccaucugauggguccacagccaaccucguuccagaggucaacaaugagguuauggcuuuggagcccguuguuggugccgccauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuuuguugauccccuuacccgauguuaggaauaauuucuaucacuacaaucaaucaaaugaccccacuaucaaauugauagcaauguuguauacaccucuuagggcuaauaaugcuggggacgaugucuucacaguuucuugucggguacucacgagaccaucccccgauuuugauuucauauuucuagugccacccacaguugaaucaagaacuaaaccauucucugucccaauuuuaacuauugaggagaugaccaauucaagauuccccauuccuuuggaaaagcuguucacgggccccagcagugccuuuguuguucaaccacaaaacggcaggugcacgacugauggcgugcuccuagguaccacccaacugucuccugucaacaucugcaccuucagaggggaugucacccauauuacagguacucauaacuacgcaaugaauuuggcugcucaaaauuggaacaguuaugacccaacagaagaaaucccagccccucuaggaacuccagauuucgugggaaagauccaaggugugcucacccaaaccacgagggcagauggcucaacccgugcccacaaagcuacaguguacacugggagcgccgaauuugcuccaaaacuggguagaguccaauuugccacugacacagacagugauuuugauacuaaccaaaacacaaaguucaccccagucggugucauccaggaugguaauacugcccaccaaaaugaaccccaacaauggguacucccaaguuacucaggcagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcucugcuaagauuugugaauccagacacagguaggguuuuguuugaguguaagcuucauaaaucagguuaugucacaguggcucacaccggccaacaugauuugguuaucccccccaaugguuauuucagauuugauuccugggucagccccuucuacacacuugcccccaugggaaauggaacggggcguagacguuaa

SEQ ID NO: 7821 - RNA, 1617 nt, Artificial Sequence
  VP1__Norovirus_and/or_Norovirus-like__KF060101
augaagauggcgucgagugacgccaacccaucugauggguccacagccaaccucgucccagaggucaacaaugagguuauggcuuuggagcccguaguuggugccgcuauugcggcaccuguggcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagagaucccagccccccugggaacuccagauuucguggggaagauucaaggcgugcucacccaaaccacaagggcagauggcucgacccgcggccacaaagcuacaguguacacugggagcgccgacuuuucuccaaaacuggguaggguucaauuugccacugacacagacaaugauuuuguagcuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7822 - RNA, 1617 nt, Artificial Sequence
  VP1__Norovirus_and/or_Norovirus-like__KF060096
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagcccuagccaggucacuauguucccccauauaguaguagacguuaggcaacuagaaccuguguugauucccuuacccgauguuaggaauaauuucuaucauuacaaucaaucaaaugaccccacuauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgucuuugcuccaaaacuggguagaguucaauuugaaacugacacagaccaugauuuugaagcuaaccaaaacacaaaguucaccccaguuggugucauacaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7823 - RNA, 1617 nt, Artificial Sequence
  VP1__Norovirus_and/or_Norovirus-like__KF060071
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgaccgauggcgugcuccuagguacuacccaacuguccccugucaacaucugcacuuucagaggggaugucacccauauuucaggcagucguaacuacacaaugaauuuggucucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggugucauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccgggugcagcggguaccccaacauggauuuggacugucugcucccccaggaaugggugcaguauuucuaccaagaggcagccccagcacaaucugauguggcccuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaauucuacacacuugcccccaugggaaaugggacggggcguagacguuaa

SEQ ID NO: 7824 - RNA, 1617 nt, Artificial Sequence
  VP1__Norovirus_and/or_Norovirus-like__KF060056
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguauugauucccuuacccgauguuaggaauaauuucuaucauuacaaucaaucaaaugaccccaccauuaaauugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuugugggaaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacuguuugcucccccaggaaugggugcaguacuucuaccaagaggcagcuccagcacaaucugauguggcucugcuaagauuugugaauccagacacagguaggguuuuguuugaguguaagcuucauaaaucaggcuaugcuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7825 - RNA, 1617 nt, Artificial Sequence
  VP1__Norovirus_and/or_Norovirus-like__JX439836
augaagauggcgucaagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcguccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguuaauccccuuacccgauguuaggaauaauuucuaccauuauaaucaaucaaaugaccccaccaucaaauugauagccaugcuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacuggaagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcuaccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7826 - RNA, 1617 nt, Artificial Sequence
  VP1__Norovirus_and/or_Norovirus-like__HF952129
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguaucccccagaaacgcuccaggugaaauauuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagucaggucacuauguuuccccauauaauaguagauguuaggcaauuggaaccuguguugauucccuuacccgauguuaggaauaauuucuaccauuauaaucaaucaaaugaccccaccaucaaauugauagcaauguuguauacaccacuuagggcuaauaaugcuggggacgaugucuucacaguuucuugucgaguucucacgagaccaucccccgauuuugauuucauauucuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucauaacuacacaaugaauuuggccucccaaaauuggaacaguuacgauccaacagaagaaaucccagccccucuaggaaccccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccagaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcacacacuggccaacaugauuugguuaucccccccaaugguuauuuuagauuugauuccugggucaaccaguucuacacacuugccccuaugggaaaugggacggggcguagacguuaa

SEQ ID NO: 7827 - RNA, 1617 nt, Artificial Sequence
  VP1__Norovirus_and/or_Norovirus-like__KC409273
augaagauggcgucgaaugacgccaacccaucugauggguccgcagccagccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugaugcggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7828 - RNA, 1617 nt, Artificial Sequence
  VP1__Norovirus_and/or_Norovirus-like__KC409242
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaacuucccaacugaagguuugagccccagccaggucacuauguucccccacauaauaguagauguuaggcaauuggaaccuguguugauucccuuacccgauguuaggaauaauuucuaucauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagcgccuuuguuguucaaccacaaaacggcaggugcacgacugauggcgugcuccuagguacuacccaacugucucccgucaacaucugcaccuucagaggggacgucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguagcaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacugguaggguuuuguuugaguguaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacguuaa

SEQ ID NO: 7829 - RNA, 1617 nt, Artificial Sequence
  VP1__Norovirus_and/or_Norovirus-like__JX445167
augaagauggcgucgagugacgccaacccaucugauggguccacagccaaccuugucccagaggucaacaaugagguuauggcuuuggagcccguaguuggugccgccauugcggcaccuguggcgggccaacaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaccaaucaaaugaccccaccaucaaauugauagcaauguuguacacaccacuuagggcuaauaaugccggggacgaugucuucacaguuucuugucgaguucucacgaggccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucacaacuacacaaugaauuuggccucccaaaauuggaauaguuacgauccaacagaagaagucccagccccucuaggaacuccagauuucguggggaagauucaaggugugcucacccaaaccacaaggacaaaugguucgacccgcggccacaaagccacaguguacacugggagcgccgacuuuucuccaaaacuggguagaguucaauuugccacugacacaaacaaugauuuugaaacuaaccaaaacacaaaguucaccccagucgguguuauccaggaugguaguaccaccccccgaaaugaaccccaacaaugggugcucccaaguuauucaggcagaaacacucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagguuugugaauccagacacagguaggguuuuguuugaguguaagcuucauaaaucaggcuauguuacaguggcucacacuggccaacaugauuugguuaucccucccaaugguuauuucagauuugauuccugggucaaccaguucuacacacuugcccccaugggaaaugggacggggcguagacguuaa

SEQ ID NO: 7830 - RNA, 1617 nt, Artificial Sequence
  VP1__Norovirus_and/or_Norovirus-like__JX445156
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccuuuacccgauguuaggaauaauuucuaucacuauaaccaaucaaaugaccccaccaucaaauugauagcaauguuguauacaccacuaggggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcucuuagguaccacccaacugucuccugucaacaucugcaccuucagaggggaugucacccacauugcugguacucaagaauacacaaugaaucuggccucccaaaacuggaacaauuaugacccaacagaagaaaucccagccccucuggggacuccagauuucguggguaagauccaaggcgugcucacccaaaccacaaggagggauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuauucagguagagauagucacaaugugcaccuagccccugccguggcccccucuuuuccgggugagcaacuucuuuucuucagguccacuaugcccggaugcagcggguaucccaacaugaauuuggauugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggucaacaugauuuaguuaucccccccaauggcuauuuuagauuugauuccugggucaaccaguucuacacacuugcccccaugggaaauggaacggggcguagacguuaa

SEQ ID NO: 7831 - RNA, 1617 nt, Artificial Sequence
  VP1__Norovirus_and/or_Norovirus-like__GQ856458
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcgcucaccgccggaaaaauuauauuugcagcagucccaccaaauuuuccaacugaaggcuugagucccagccagguuacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacagucgagucaagaaccaaaccauuuacugucccaaucuuaacuguugaagaaaugaccaauucaagauuccccauuccucuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcccacucaaaccacaaagggagauggcucgacccguggccauaaagcuacaguuuacacugggagugcccccuuuacuccaaagcugggcaguguucaauucaguacugauacagaaaaugauuuugaagcucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaggaggcagcuccagcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7832 - RNA, 1617 nt, Artificial Sequence
  VP1__Norovirus_and/or_Norovirus-like__AB541299
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacacucucuauacuuuagguccacuaugcccggaugcagcggguaucccaacauggauuuggauugccugcucccccaggagugggugcagcacuucuaccaagaggcagcuccagcacaaucugauguggcgcuauugagauuugugaauccagacacggguaggguccuguuugagugcaagcuucacaaaucaggcuaugucacaguggcucacaccggccagcaugaucuggucaucccccccaaugguuauuuuagguuugauuccuggguuaaucaguucuacacacuugcccccaugggaaauggaacggggcguagacguuaa

SEQ ID NO: 7833 - RNA, 1617 nt, Artificial Sequence
  VP1__Norovirus_and/or_Norovirus-like__AB541195
augaagauggcgucgagugacgccaacccaucugauggguccgcagccaaccucgucccagaggucaacaaugagguuauggcuuuggagcccguugucggugccgcuauugcggcgccuguggcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguuaauccccuuaccugauguuaggaauaauuucuaucacuauaaccagucaaaugauucuaccauuaaauugauagcaaugcuguauacaccacuuagggcuaauaaugcuggggaagaugucuucacagucucuugucgaguccucacgaggccauccccugauuuugauuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaacuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuuuacuccaaagcugggcaauguucaauucaguacugauacagaaaaugauuuugaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuucccgggugaacaacuucuuuucuucagguccacuaugcccggaugcagcggguaucccaacauggauuuggauugccuacucccccaggagugggugcagcacuucuaccaagaggcggcuccagcacaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacguuaa

SEQ ID NO: 7834 - RNA, 1617 nt, Artificial Sequence
  VP1__Norovirus_and/or_Norovirus-like__AB504322
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggcuagaauguauaaugguuaugcaggugguuuugaagugcaggugauccucgcggggaacgcguucaccgccggaaaaauuauauucgcagcagucccaccaaauuuuccaacugaaggcuugagucccagccaggucacuauguucccccacauaauaguagauguuaggcaauuggaaccuguguugauccccuuaccugauguuaggaauaauuucuaucacuauaaucaguuaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcaggugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagguuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugacuuugaaacucaccaaaacacaaaauucaccccagucggugucauccaggaugguagcaccacccaccggaaugaaccccaacaaugggugcucccaaguuauucagguagaaauguccauaauguacaccuagccccugcuguagcccccacuuuuccgggugaacagcuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7835 - RNA, 1617 nt, Artificial Sequence
  VP1__Norovirus_and/or_Norovirus-like__EU876892
augaagauggcgucgaaugacgccaacccaucugauggguccgcagccaaccucguccuagaggucaacaaugagguuauggcuuuggagcccguugucggugccgcuaucgcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucaccauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucggauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7836 - RNA, 1617 nt, Artificial Sequence
  VP1__Norovirus_and/or_Norovirus-like__EU876891
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuguggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaaaaaaugaccaauucaagauuccccauuccuuuggaaaaguuguucacgggucccagcggugccuuuguuguccagccacaaaauggcaggugcacgacugauggcgugcucuuaggcaccacccaacugucuccugucaacaucugcaccuucagaggggaugucacccacaucgcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccauaaagcuacaguuuacacugggagugcccccuuuaccccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcauuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7837 - RNA, 1617 nt, Artificial Sequence
  VP1__Norovirus_and/or_Norovirus-like__AB294792
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuugugcaagccccugguggagaguucacaguauccccuagaaacgcuccaggugaaauacuauggagcgcgcccuuaggcccugaucugaauccauaccuuucucaccuggccagaauguacaaugguuaugcaggugguuuugacgugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuucccauuccuuuggaaaaauuguucacgggucccagcagugccuuugucguccaaccacaaaauggcaggugcacgacugauggcgugcucuuaggcacuacccaacugucccccgucaacaucugcaccuucagaggagaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuucacuccaaagcugggcagcguucaguucgccacugacacagacaaugauuuugaaacuggccaaaacacaagguucaccccagucggugucauccaggaugguaguaguacccacagaaaugaaccccaacaauggguacucccagauuacucagguagaacuguucauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucacaaagcaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 7838 - RNA, 1617 nt, Artificial Sequence
  VP1__Norovirus_and/or_Norovirus-like__AB303932
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaauuauauuugcagcagucccaccaaauuucccaacugaaggcuugagccccagccaggucacuauguuuccccauauaauaguagauguuaggcaacuggaaccuguguugauccccuuaccugauguuaggaacaauuucuaucacuacaaucaaucaaaugaccccaccauuaaauugauagcaaugcuguauacaccacucagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggagaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucaccccaaagcugggcaguguccaauucaacacugauacaaacaaugauuuugaaacuggccaaaacacgagauucaccccagucgguguuguccaggaugguaaugguacccaccaaaaugaaccccaacaaugggugcucccaagcuacucagguagaacuggucauaauguacaccuagcccccgccguagcccccacuuuuccgggugagcaacuucuuuucuucagguccacuaugcccggaugcagcggguaccccaauaugaauuuggauugucuacucccccaggaaugggugcagcacuucuaccaagaggcagcuccagcacaaucugauguggcucugcuaagauuugugaauccagacacagguaggguucuauuugagugcaaacuucauaaaucaggcuaugucacaguggcucacacuggccagcaugauuugguuaucccccccaauggcuacuuuagauuugauucuugggucaaccaauucuacacacuugcccccaugggaaaugggacggggcguagacguuaa

SEQ ID NO: 7839 - RNA, 1617 nt, Artificial Sequence
  VP1__Norovirus_and/or_Norovirus-like__LC177660
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcagguggcuuugaagugcagguaauucucgcggggaaugcguucaccgccgggaaggucauauuugcagcagucccaccaaauuuuccaacugaaggcuugagccccagucaggucacuauguucccccauauaguaguagauguuaggcaacuagaaccuguguugauucccuuacccgauguuaggaauaauuucuaucauuacaaucaaucaaaugacccuaccauuaaauugauagcaauguuguauacaccacuuagggcuaauaaugcuggggaugaugucuucacaguuucuugcagaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacgaugaauuuggcuucucaaaauuggaacaauuaugacccaacagaagaaaucccagccccucugggaacuccagauuuuguggggaagauucaaggcaugcucacccaaaccacaaggacagauggcucaacacgcggccacaaagcuacaguguauacugggagcgccgacuuugcuccaaaacuggguagaguucaauuugaaacugacacagaccaugauuuugaagcuaaccaaaauacaaaguucaccccaguuggugucauccaagaugguagcaccacccaccgaaacgaaccccaacagugggugcucccaaguuacucaggcaggaacacuccuaaugugcauuuggcccccgcuguggcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaauuaggcuauguuacaguggcucacacuggccaacaugauuugguuaucccccccaaugguuauuuuagguuugauuccuggguaaaccaguuuuacacgcuugcccccaugggaaauggaacggggcguagacguuaa

SEQ ID NO: 7840 - RNA, 1617 nt, Artificial Sequence
  VP1__Norovirus_and/or_Norovirus-like__KX608866
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguguccccuagaaacgcuccaggugagauacuauggagcgcgcccuuaggcccugauuugaaucccuaccuuucccauuuggccagaauguacaaugguuaugcaggugguuuugaagugcagguaauccucgcggggaaugcguucacugccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccacuauaaucagucaaaugaccccaccaucaaauugauagcaauguuguacacaccacuuagggcuaacaacgccggggacgaugucuucacaguuucuugucgaguucucacgagaccaucccccgauuuugauuucauauuuuuggugccacccacaguugaaucaagaaccaaaccauucucugucccaguuuuaaccguugaggagaugaccaauucaagguuccccauuccuuuggaaaaguuguucacgggccccaguagugccuuuguuguucaaccacaaaacggcaggugcacgacugauggcgugcuccuagguacuacccaacugucucccguuaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguagcuaaccaaaauacaaaguucaccccagucgguguuauccaggaugguaguacuaccccccgaaaugaaccccaacaaugggugcucccaaguuacucaggcagaaacacucauaaugugcaccuagcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguagggucuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7841 - RNA, 1617 nt, Artificial Sequence
  VP1__Norovirus_and/or_Norovirus-like__KX371603
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugaccccaccaucaaauugauagcaauguuguauacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguuuacgggccccaguagugccuuuguuguucaaccacaaaacggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagguuugauuccugggucaaccaguucuacacacuugcccccaugggaaaugggacggggcguagacguuaa

SEQ ID NO: 7842 - RNA, 1617 nt, Artificial Sequence
  VP1__Norovirus_and/or_Norovirus-like__KX354086
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaaggauugagccccagccaggucacuauguucccccacauaauaguagauguuaggcaguuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugucgaguccuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagcgccuuuguuguucaaccacaaaacggcaggugcacgacugauggcgugcuccuagguaccacucaacugucuccugucaacauuugcacauucaggggggaugucacccauauuccaggcagucauaacuacacaaugaauuuagccucccaaaauuggaacaguuaugacccaacagaagaaaucccagccccucuaggaacuccagauuucguagggaagauucagggugugcucacucaaaccacaaguacaaauggcucgacccgcggccacaaagcuacaguguacacugggagcgccgacuuuucuccaaaacuggguagaguucaauuugccacugacacaaacgaugauuuugaaacuaaccaaaacacaaaauucaccccagucggcguuauccaggaugguagcacuaccccccgaaaugaaccccaacaaugggugcucccaaguuacucaggcagaaacacucacaaugugcaccuggcccccgcuguagcccccacuuucccgggcgagcagcuccucuucuuuagauccacuaugcccggaugcagcggguaccccaacauggacuuggauugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 7843 - RNA, 1617 nt, Artificial Sequence
  VP1__Norovirus_and/or_Norovirus-like__KX354080
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcacccuuaggcccugauuugaaucccuaccuuucucauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucaccauguucccccacauaauaguggauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacagucucuugucgaguucucacgagaccauccccugauuuugauuucauauuuuuggugccacccacaguugaaucaagaacuaaaccauucucugucccaguuuuaacuguugaggagaugaccaauucaagguuccccauuccuuuggaaaaguuguucacgggccccagcagugccuuuguuguucaaccacaaaacgguaggugcacgaccgauggcgugcuccuggguacuacccaacugucuccugucaacaucugcaccuucagaggggaugucacccacauuucaggcagucgcaacuacacaaugaauuuggccucccaaaauuggaacaguuacgauccaacagaagaaaucccagccccccuaggaacuccagauuucguggggaagauucaaggugugcucacccaaaccacaaggacagauggcucgacucgcggccacaaagcuacaguguacacugggagcgccgacuucucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggagugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7844 - RNA, 1617 nt, Artificial Sequence
  VP1__Norovirus_and/or_Norovirus-like__KX354054
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaccugaaucccuaccuuucccauuuggcuagaauguacaaugguuaugcagguggcuuugaagugcagguaauccucgcggggaacgcguucaccgccgggaaaaucauauuugcagcagucccaccaaauuucccaacugaagguuugagccccagucaggucacuauguucccccacauaauaguagauguuaggcaauuggaaccuguguugauccccuuacccgauguuaggaauaauuucuaucauuauaaucaaucaaaugaccccaccaucaaauugauagcaauguuguauacaccacuuagggcuaauaaugccggggacgaugucuucacaguuucuugucgaguucucacgagaccaucccccgauuuugauuucauauuuuuggugccacccacaguugaaucaagaacuaaaccauuuucugucccaguuuuaacuguugaggaaaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaagcuggguagaguucaauuugccacugacacagacaaugauuuugaaacuaaccaaaacacaaaguucaccccagucgguguuauccaggaugguaguaccaccccccgaaaugaaccccaacaaugggugcucccgaguuacucaggcagaaacauucauaaugugcaccuggcccccgcuguagcccccacuuucccgggcgagcagcuccucuuuuuuagaucuacuaugcccggaugcagcggguaccccaacauggauuuggacugucugcucccccaggaaugggugcaguacuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7845 - RNA, 1617 nt, Artificial Sequence
  VP1__Norovirus_and/or_Norovirus-like__KX354041
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaccugaaucccuaccuuucccauuuggcuagaauguacaaugguuaugcagguggcuuugaagugcagguaauccucgcggggaacgcguucaccgccgggaaaaucauauuugcagcagucccaccaaauuucccaacugaagguuugagccccagucaggucacuauguucccccacauaauaguagaugucaggcaauuggaaccuguguugauccccuuacccgauguuaggaauaauuucuaucauuauaaucagucaaaugaccccaccaucaaauugauagcaauguuguauacaccacuuagggcuaauaaugccggggacgaugucuucacaguuucuugucgaguucucacgagaccaucccccgauuuugauuucauauuuuuggugccacccacaguugaaucaagaacuaaaccauuuucucucccaguuuuaacuguugaggaaaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgucgacuuuucuccaaagcuggguagaguucaauuugccacugacacagacaaugauuuugaaacuaaccaaaacacaaaguucaccccagucgguguuauccaggaugguaguaccaccccccgaaaugaaccccaacaaugggugcucccgaguuacucaggcagaaacauucauaaugugcaccuggcccccgcuguagcccccacuuucccgggcgagcagcuccucuuuuuuagaucuacuaugcccggaugcagcggguacccuaacauggauuuggacugucugcucccccaggaaugggugcaguacuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacacuugcccccaugggaaaugggacggggcguagacguuaa

SEQ ID NO: 7846 - RNA, 1617 nt, Artificial Sequence
  VP1__Norovirus_and/or_Norovirus-like__KX354029
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggaccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaauuagaaccuguguugauucccuuacccgauguuaggaauaauuucuaucauuauaaucaaucaaaugaccccaccauuaaguugauagcaauguuguauacuccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaagcuguucacgggucccagcagcgccuuuguuguccaaccacaaaacggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaccccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaacacucauaaugugcaccuggcccccgcuguagcccccacuuuuccgggugagcaacuucucuucuucagauccaccaugcccggaugcagcggguaccccaacauggauuuggacugucugcucccccaggaaugggugcaguacuucuaccaggaggcagccccagcacaaucugauguggcucugcuaagauuugugaauccagacacagguaggguuuuguuugaguguaagcuucauaaaucaggcuauguuacaguggcuuacacuggccaacaugauuugguuauuccccccaaugguuauuuuagauuugauuccugggucaaccaguucuacacgcuugcccccaugggaaauggaacggggcguagacguuaa

SEQ ID NO: 7847 - RNA, 1617 nt, Artificial Sequence
  VP1__Norovirus_and/or_Norovirus-like__KX353977
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagucaggucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaaccguugaggagaugaccaauucaagguuccccauuccuuuggaaaaguuauucacgggccccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguaggguucaauuugccacugacacagacaaugauuuugaaacuaaccaaaacacaaaguucaccccagucgguguuauccaggauggugguaccaccccccgaaaugaaccccaacaaugggugcucccaaguuacucaggcagaaacauucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguugagauuuguaaauccagacacagguaggguuuuguuugaguguaagcuucauaaaucaggcuauguuacaguggcucacacuggccaacaugauuuagucauccccccuaaugguuauuuuagauuugauuccugggucaaccaguucuacacacuugccccuaugggaaaugggacggggcguagacguuaa

SEQ ID NO: 7848 - RNA, 1617 nt, Artificial Sequence
  VP1__Norovirus_and/or_Norovirus-like__KX353965
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccaccaucaaauugauagcaauguuguacacaccacuuagagcuaauaaugcuggggacgaugucuucacaguuucuugucgaguucucacgagaccaucccccgauuuugacuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauacuccaggcagucauaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuuccccaaaacuggguagaguucaauuugccacugacacagacaaugauuuugaaacuaaccaaaacacaaaguucaccccagucgguguuauccaggaugguaguaccaccccccggaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugacuccugggucaaccaguucuacacacuugcccccaugggaaaugggacggggcguagacguuaa

SEQ ID NO: 7849 - RNA, 1617 nt, Artificial Sequence
  VP1__Norovirus_and/or_Norovirus-like__KU311158
augaagauggcgucgagugacgccaacccaucugauggguccgcagccaaccucgucccagaggucaacaaugagguuauggcucuggagcccguugucggugccgccauugcggcaccuguagcgggccaacaaaauguaauugaccccuggauuagaaauaauuuugugcaagccccugguggagaguucacaguauccccuagaaacgcuccaggugaaauacuauggagcgcgcccuugggcccugaucuaaaucccuaccuuucccauuuggcuagaauguacaaugguuaugcaggugguuuugaagugcaggugauucucgcggggaacgcguucaccgccgggaaggucauauuugcagcagucccaccaaauuuuccaacugaaggcuugagccccagccaggucacuauguucccccacauagugguagauguuaggcaacuagaaccuguguugauucccuuacccgauguuaggaauaauuucuaucauuauaaccaaucaaaugaccccaccauuaaguugauagcaauguuguauacaccacuuagggcuaacaaugcuggggaugaugucuucacagucucuugccgaguucucacgagaccaucccccgacuuugauuucauauuucuagugccacccacaguugagucaagaacuaaaccauucucugucccaguucuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccuguuaacaucugcaccuuuagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaagggcagauggcucaacacgcggccacaaagccacaguguacacugggagcgccgacuuugcuccaaaacuggguagaguucaauuugaaacugacacagaccaugauuuugaagcaaaccaaaacacaaaguucaccccaguuggugucauccaagaugguggcaccacccaccgaaaugagccccaacagugggugcucccaaguuacucaggcagaaauacuccuaaugugcaucuggcccccgcuguagcccccacuuucccgggugagcaacuucucuucuuuagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucagguuauguuacaguggcucacacuggccaacaugauuugguuauccccccuaaugguuauuuuagguuugauuccugggucaaccaguuuuacacgcuugcccccaugggaaauggaacggggcguagacguuaa

SEQ ID NO: 7850 - RNA, 1617 nt, Artificial Sequence
  VP1__Norovirus_and/or_Norovirus-like__AB974408
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaucugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgacgccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuuugugggaaagauccaggguaugcucacccaaacuacaaagggagaugguucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguaacaccacccaccgaaaugaaccccaacaaugggugcucccaaguuauucagguagaaaugucccuaaugugcaccuagccccugcuguagcccccacuuucccgggugaacaacuucuuuucuuuagguccacuaugcccggaugcagcggguaucccaacauggauuuggauugccuacucccucaggagugggugcagcacuucuaccaagaggcagccccagcacaaucugauguggcucuauugagguuugugaacccagacacggguaggguccuauuugaguguaaacuucauaaaucagguuaugucacaguagcucacaccggccagcaugauuuggucaucccccccaaugguuauuuuagguuugauuccuggguuaaucaauucuacacacuugcccccaugggaaauggaacggggcguagacguuaa

SEQ ID NO: 7851 - RNA, 1617 nt, Artificial Sequence
  VP1__Norovirus_and/or_Norovirus-like__KR904221
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauauuguggagcgcacccuugggcccugaucuaaaucccuaccuaucccauuuggccagaauguauaaugguuaugcaggugguuuugaagugcagguaauccucgcggggaacgcguucaccgccgggaagguuauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggacgaugucuucacaguuucuugccgaguucucacgagaccaucccccgauuuugauuucauauuucuagugccacccacaguugagucuagaacuaaaccauucucugucccaguuuuaacuguugaggagaugacuaauucaagauuccccauuccuuuggaaaaguuguucacgggucccagcagugccuuuguuguucaaccacaaaacgguaggugcacgacugauggcgugcuccuaggcaccacccaauugucuccugucaacaucugcaccuucagaggggaugucacccacaucacagguagucguaacuacacaaugaauuuggcuucucaaaauuggaacaauuaugacccaacagaagaaaucccagccccucuaggagcuccagauuuuguggggaagauucaaggcaugcucacccaaaccacaagggcagauggcucaacacgcggccacaaagcuacaguguacacugggagcgccgacuuugcuccaaaacugggcaggguucaauuugaaacugacacagaccaugauuuugaagcuaaccaaaacacaaaguucaccccagucggugucauccaagaugguagcaccacccaccgaaaugaaccccaacagugggugcucccaaguuacucaggcaggaauacucauaauguucaucuggcccccgcuguagcccccacuuuuccgggugagcaacuucucuucuuuagauccaccaugcccggguguagcggguaccccaacauggauuuggacugucugcucccccaggaaugggugcaguacuucuaccaagaggcagcuccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggagcggggcguagacgauaa

SEQ ID NO: 7852 - RNA, 1617 nt, Artificial Sequence
  VP1__Norovirus_and/or_Norovirus-like__AB933765
augaagauggcgucuagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgagcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugccgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggagaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaaugguucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggauggugguacuacccaccgaaaugaaccccaacaaugggugcuuccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacguuaa

SEQ ID NO: 7853 - RNA, 1617 nt, Artificial Sequence
  VP1__Norovirus_and/or_Norovirus-like__AB933761
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaucaauuuuguacaagccccugguggagaguuuacaguauccccuagaaacgcuccaggugaaaucuuauggagcgcgcccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggaugaugucuucacaguuucuugucgaguucuuacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacuggaagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcuaccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7854 - RNA, 1617 nt, Artificial Sequence
  VP1__Norovirus_and/or_Norovirus-like__AB933748
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcggaacauuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuacaaucaaucaaaugaccccaccaucaaauugauagcaauguuguacacaccacuuagggcuaauaaugccggggacgaugucuucacaguuucuugucgaguucucacgagaccaucccccgauuuugauuucauauuucugguaccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaauggcaggugcacgacugauggugugcuccuaggcacuacccaacugucucccgucaacaucugcaccuucagaggggaugucacccauauuccaggcagucguaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguccaauuugccacugacacagacaaugauuuugaaaccaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcgcugcuaagauuugugaacccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7855 - RNA, 1617 nt, Artificial Sequence
  VP1__Norovirus_and/or_Norovirus-like__EU921386
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuugugcaagccccugguggagaguucacaguaucccccagaaacgcuccaggugaaauacuauggagcgcgcccuuaggcccugaucugaaucccuaccuaucucauuuggcuagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguauacaccacuuagggccaauaaugcuggggaagaugucuucacagucucuugucgaguccucacgaggccguccccugauuuugauuuuauauuuuuggugccacccacaguugagucaagaacuaaaccauuuaccgucccaaucuuaacuguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucauccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccacaaagcuacaguuuacacugggagugcccccuuuacuccaaaacugggcaguguucaauucaguacugauacagaaaaugauuuugaagcucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuauucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucauaccggccagcaugauuuggucaucccccccaauggcuauuuuagguuugauuccuggguuaaucaauucuacacacuugcccccaugggaaauggaacggggcguagacguuaa

SEQ ID NO: 7856 - RNA, 1617 nt, Artificial Sequence
  VP1__Norovirus_and/or_Norovirus-like__KP244321
augaagauggcgucgagugacgccaacccaucugauggguccacagccaaccucgucccagaggucaacaaugagguuauggcuuuggagcccguaguuggugccgcuauugcggcaccuguggcgggccaacaaaauguaauugaccccuggauuagaaauaauuuuguacaagccccugguggagaguuuacaguauccccuagaaacgcuccaggugaaauauuauggagcgcgcccuuaggcccugaucugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguggauguuaggcaauuggagccuguguugauccccuuacccgauguuaggaauaauuucuaccauuauaaucaaucaaaugaccccaccaucaaauugauagcaauguuguacacaccacuuagggcuaauaaugcuggggacgacgucuucacaguuucuugucgaguucuuacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuucaggcagucguaacuacacaaugaauuuggccucccaaaacuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaauggaugcucccaaguuacucaggaagaaacacucauaaugugcaccuggcccccgcuguagccccuacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguugagauuugugaauccagacacagguaggguuuuguuugagugcaagcuucauaaaucaggcuauguuacaguggcucacacuggccaacaugauuugguuaucccccccaaugguuauuuuagauuugauuccugggucaaccaguuuuacacacuugcccccaugggaaaugggacggggcguagacguuaa

SEQ ID NO: 7857 - RNA, 1617 nt, Artificial Sequence
  VP1__Norovirus_and/or_Norovirus-like__KP698923
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauagugguugauguuaggcaacuagaaccuguguugauucccuuaccugauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuacgauccaacagaagaaaucccagccccucuaggaacuccagacuuuguggggaagauucaaggcgugcuuacccaaaccacaaggacagauggcucaacacgcggccacaaagccacaguguacacugggagcgccgacuuugcuccaaaacuggguagaguucaauuugaaacugacacaaaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcugcagcccccacuuuuccgggugagcagcuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaauguaagcuucauaaaucaggcuauguuacaguggcucacacuggccaacaugauuugguuaucccccccaaugguuauuuuagguuugauuccugggucaaccaguuuuacacgcuugccccuaugggaaauggaacggggcguagacguuaa

SEQ ID NO: 7858 - RNA, 1617 nt, Artificial Sequence
  VP1__Norovirus_and/or_Norovirus-like__KP241905
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcgggugguuuugaagugcgggugauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaauuuuaacuguugaggagaugaccaauucaagauuccccauuccuuuggaaaaguuguucacgggccccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaauuccagauuuuguggggaagauucaaggcaugcucacccaaaccacaaggacagauggcucaacacgcggccacaaagcuacaguauacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggucaacaugauuugguuaucccccccaaugguuauuuuagguuugauuccugggucaaccaguuuuacacgcuugcccccaugggaaauggaacggggcguaggcguuaa

SEQ ID NO: 7859 - RNA, 1617 nt, Artificial Sequence
  VP1__Norovirus_and/or_Norovirus-like__KP176393
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuucccaacugaaggcuugagccccagccaggucacuauguucccccauauaguaguagauguuaggcaacuagaaccuguguugauucccuuacccgauguuaggaauaauuucuaucauuacaaucaaucaaaugaccccacuauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaauuggguagaguucaauuugaaacugacacagaccaugauuuugaagcuaaccaaaacacaaaguucaccccaguuggcgucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccagcauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7860 - RNA, 1617 nt, Artificial Sequence
  VP1__Norovirus_and/or_Norovirus-like__KP096330
augaagauggcgucgagugacgccaacccaucugauggguccgcagccaaccucgucccagaggucaacaaugagguuauggcucuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugacuucauauuucuagugccacccacaguugagucaagaacuaaaccauucucugucccaguuuuaacugucgaggagaugaccaauucaagauuccccauucccuuggaaaaguuguucacgggucccagcagugccuuuguuguccaaccacaaaacgguaggugcacgacugauggcgugcuccuaggcaccacccaacugucuccugucaacaucuguaccuuuagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaacaggcuauguuacaguggcucauacuggccaacaugauuugguuaucccccccaaugguuauuucagguuugauuccugggucaaccaguuuuacacgcuugcccccaugggaaauggaacggggcguagacguuaa

SEQ ID NO: 7861 - RNA, 1617 nt, Artificial Sequence
  VP1__Norovirus_and/or_Norovirus-like__KM982953
augaagauggcgucgagugacgccaacccaucugauggguccgcagccaaccucgucccagaggucaacaaugagguuauggcucuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaacaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuuuagaggagaugucacccauaucacagguagucguaacuacacaaugaauuuggcuucucaaaauuggaacaauuaugacccaacagaagaaaucccagccccucuaggaauuccagauuuuguggggaagauucaaggcaugcucacccaaaccacaaggacagauggcucaacacgcggccacaaagccacaguguacacugggagcgucgacuucgcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcguagacguuaa

SEQ ID NO: 7862 - RNA, 1617 nt, Artificial Sequence
  VP1__Norovirus_and/or_Norovirus-like__KM982936
augaagauggcgucgagugacgccaacccaucugauggguccgcagccaaccucgucccagaggucaacaaugagguuuuggcuuuggagcccguuguuggugccgccauugcggcaccuguagcgggccaacaaaauguaauugaccccuggauuaggaauaauuuuguacaagccccugguggagaguuuacaguauccccuagaaacgcuccaggugaaauacuauggagcgcgcccuugggcccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuuuauauuucuagugccacccacaguugagucaagaacuaaaccauucucugucccaauuuuaacuguugaggagaugaccaauucaagauuccccauuccuuuggaaaagcuguucacgggucccagcagugccuuuguuguccaaccacaaaacgguaggugcacgacugauggcgugcuccuaggcaccacccaacugucuccugucaacaucugcaccuucagaggagaugucacccauaucacagguagucauaacuacacaaugaauuuggcuucucaaaauuggagcaauuaugauccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccgguugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuacguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7863 - RNA, 1617 nt, Artificial Sequence
  VP1__Norovirus_and/or_Norovirus-like__KM514073
augaagauggcgucgagugacgccaacccaucugauggguccgcagccaaccucgucccagaggucaacaaugagguuauggcucuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguacuucucgcggggaacgcguucaccgccgggaaggucauauuugcagcagucccaccaaauuuuccaacugaagguuugagccccagccaggucacuauguucccccauauaguaguagauguuaggcaacuagaaccuguguugauucccuuacccgauguuaggaauaauuucuaucauuacaaucaaucaaaugaccccaccauuaaauugauagcaauguuguacacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuuuagaggagaugucacccauaucacagguagucgcaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgauuuugcuccaaaacuggguagaguucaauuugaaacugacacagaccaugauuuugaagccaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcgcagacguuaa

SEQ ID NO: 7864 - RNA, 1617 nt, Artificial Sequence
  VP1__Norovirus_and/or_Norovirus-like__KM268086
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucgcgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccagucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccauaaagccacaguguacacugggagcgccgacuuugcuccaaaacuggguagaguucaauuugaaacugacacagaccaugauuuugaagcuaaucaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7865 - RNA, 1617 nt, Artificial Sequence
  VP1__Norovirus_and/or_Norovirus-like__KM198552
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguacaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggagccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcacuuucagaggggaugucacccacauugcagguucucguaacuacacaaugaauuuggcaucuauaaauuggaacaauuaugacccaacagaagaaauuccagccccucugggaacuccagauuucgugggaaagauccaaggugugcucacucaaaccacaaaaggagauggcucgacccguggucacaaagcuacaguuuacacugggagugcccccuuuacuccaaagcugggcaguguucaauucaguacugacacagaaaaugauuuugaaacucaccaaaacacaaaauucaccccagucggugucauccaggauggugguaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugaugcggcucuauugagauuugugaauccagacacggguaggguccuguuugagugcaaacuucauaaaucaggcuaugucacaguggcucacaccggucagcaugauuuggucaucccccccaauggcuacuuuagguuugauuccuggguuaaucaguucuacacgcuugcccccaugggaaacggaacggggcguaggcgcuaa

SEQ ID NO: 7866 - RNA, 1617 nt, Artificial Sequence
  VP1__Norovirus_and/or_Norovirus-like__KJ716358
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccgccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaacaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuucguuguccaaccacaaaacgguaggugcacgacugauggcgugcuccuaggcaccacccaacugucuccugucaacaucugcaccuucagaggagcugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccauaaagccacaguguacacugggagcgccgacuuugcuccaaaacuggguagaguucaauuugaaacugacacagaccgugauuuugaagcuaaccaaaacaccaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaucaugcccggaugcagcggguaccccaacauggaucuggacugucugcucccccaggaaugggugcaguacuucuaccaagaggcagccccagcacaaucugauguggcccugcuaagauuugugaauccagacacagguaggguuuuguuugaguguaagcuccauaaaucaggcuauguuacaguggcucacacuggccaacaugauuugguuaucccccccaaugguuauuucagguuugauuccugggucaaccaguuuuacacgcuugcccccaugggaaauggaacggggcguagacguuaa

SEQ ID NO: 7867 - RNA, 1617 nt, Artificial Sequence
  VP1__Norovirus_and/or_Norovirus-like__KJ649702
augaagauggcgucgagugacgccaacccaucugauggguccgcagccaaccucgucccagaggucaacaaugagguuauggcucuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcguagacguuaa

SEQ ID NO: 7868 - RNA, 1617 nt, Artificial Sequence
  VP1__Norovirus_and/or_Norovirus-like__KF429778
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugagauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccacuauaaucagucaaaugaccccaccaucaaauugauagcaauguuguacacaccacuuagggcuaacaaugccggggacgaugucuucacaguuucuugucgaguucucacgagaccaucccccgauuuugacuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguaccacccaacugucuccugucaacaucugcaccuucagaggggaugucacccacauugcaggcagucguaacuacacaaugaauuuggccucccaaaauuggaacagcuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucggugucauccaggauggugguacuaccccccgaaaugaaccccaacaaugggugcucccaaguuacucaggcagaaacacucacaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaagcagccccggcacaaucugauguggcacuguuaagauuugugaacccagacacagguagggucuuguuugaguguaaacuucauaaaucaggcuauguuacaguggcucacacuggccaacaugauuuaguuaucccccccaaugguuauuuuagauuugauuccugggucaaccaguucuacacacuugcccccaugggaaaugggacggggcgcagacguuaa

SEQ ID NO: 7869 - RNA, 1617 nt, Artificial Sequence
  VP1__Norovirus_and/or_Norovirus-like__KF060113
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagagcuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguaggcguuaa

SEQ ID NO: 7870 - RNA, 1617 nt, Artificial Sequence
  VP1__Norovirus_and/or_Norovirus-like__KF060106
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaccccuaccuuucccauuuggccagaauguacaaugguuaugcaggugguuucgaagugcagguaguccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuaugauccaacagaagaaaucccagccccccuagggacuccagauuucguggggaagauucaaggugugcucacccaaaccacaaggacagauggcucgacccgcggccacaaagcuacaguguauacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaacgggacggggcguagacguuaa

SEQ ID NO: 7871 - RNA, 1617 nt, Artificial Sequence
  VP1__Norovirus_and/or_Norovirus-like__KF060100
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccaucuggccagaauguacaauggcuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuagaaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauucuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacgguaggugcacgacugauggcgugcuccuagguacuacccaacugucuccugucaacaucugcaccuucagaggggaugucacccacauuucaggcagucauaacuacacaaugaauuuggccucccaaaauuggaacaguuaugauccaacagaagaaaucccagccccccuaggaacuccagauuucguggggaagauucaagguaugcucacccaaaccacaaggacagauggcucgacccgcggccacaaagcuacaguguacacugggagcgucgacuuuucuccaaaacuggguaggguucaauuuaccacugacacagacaaugauuuugaaacuaaccaaaacacaaaguucaccccagucgguguuauccaggaugguaguacuacccaccgaaaugaaccccaacaaugggugcucccaagcuacucaggcagaaacacucauaaugugcaccuggcccccgcuguagcccccacuuucccgggcgagcagcuccucuucuucagauccaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7872 - RNA, 1617 nt, Artificial Sequence
  VP1__Norovirus_and/or_Norovirus-like__KF060069
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguucacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcucuuagguacuacccaacugucuccugucaacaucugcaccuucagaggggaugucacccacauuucaggcagucauaacuacacaaugaauuuggccucccaaaauuggaacaguuaugauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuaugucacaguggcucacacuggccaacaugauuuaguuaucccccccaaugguuauuuuagauuugauuccugggucaaccaguucuacacacuugcccccaugggaaacgggacggggcguagacguuaa

SEQ ID NO: 7873 - RNA, 1617 nt, Artificial Sequence
  VP1__Norovirus_and/or_Norovirus-like__KF060055
augaagauggcgucgagugacgccaacccaucugauggguccacagccaaccucgucccagaggucaacaaugagguuauggcuuuggagcccguaguuggugccgccauugcggcaccuguggcgggccaacaaaauguaauugaccccuggauuagaaacaauuuuguacaagccccugguggagaguuuacaguauccccuagaaacgcuccaggugaaauacuauggagcgcgcccuuagguccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuagacaauuggaaccuguguugaucccuuugcccgauguuaggaauaauuucuaccauuauaaucaaucauaugaccccaccaucaaauugauagcaauguuguacacaccacuuagggcuaauaaugccggggacgaugucuucacaguuucuugucgaguucuuacgagaccaucccccgauuuugauuucauauuuuuggugccacccacaguugaaucaagaacuaaaccauucucugucccaguuuuaacugucgaggagaugaccaauucaagguuucccauuccuuuggaaaaguuguucacgggccccaguagugcuuuuguuguucaaccacaaaacggcaggugcacgacugauggcgugcuccuagguacuacccaacugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacccaaaccacaaagacaaauggcucgacccgcggccacaaagccacaguguacacugggagcgccgacuuuucuccaaagcuggguaggguucaauuugccacugacacaaacaaugauuuugaaacuaaccaaaacacaaaguucaccccagucgguguuauccaggaugguaguacuacuccccgaaaugaaccccaacaaugggugcucccaaguuacucgggcagaaacauucacaaugugcaccuggcccccgcuguagcccccacuuucccgggcgagcagcuccucuucuucagaucuacuaugcccggaugcagcggguaccccaacauggauuuggacugucugcucccccaggagugggugcaguacuucuaccaggaggcagccccagcacaaucugauguggcucuguuaagauuugugaauccagacacagguaggguuuuguuugaguguaagcuucauaaaucagguuauguuacaguggccuacacuggccaacaugauuugguuaucccccccaaugguuauuuuagauuugauuccugggucaaccaguucuacacacuugcccccaugggaaaugggacggggcguagacguuaa

SEQ ID NO: 7874 - RNA, 1617 nt, Artificial Sequence
  VP1__Norovirus_and/or_Norovirus-like__KF060028
augaagauggcgucgagugacgcccacccaucugauggguccacagccaaccucgucccagaggucaacaaugagguuauggcuuuggagcccguaguuggugccgcuauugcggcaccuguggcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagagaucccagccccccugggaacuccagauuucguggggaagauucaaggugugcucacccaaaccacaagggcagauggcucgacccgcggccacaaagcuacaguguacacugggagcgccgacuuuucuccaaaacuggguaggguucaauuugccacugacacagacaaugauuuuguagcuaaccaaaacacaaaguucaccccagucgguguuauccaggaugguaguacuaccccccgaaaugaaccccaacaaugggugcuuccaaguuacucaggcagaaacacucauaaugugcaccuggcccccgcuguggcccccacguucccgggcgagcaacuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7875 - RNA, 1617 nt, Artificial Sequence
  VP1__Norovirus_and/or_Norovirus-like__KF060022
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuagaaauaauuucuaccauuauaaucagucaaaugaccccaccaucaaauugauagcaauguuguacacaccacuuagggcuaacaaugccggggacgauguauucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcgccuucagaggggaugucacccacauuucaggcagucguaacuacacaaugaauuuggccucccaaaauuggaacaguuaugauccaacagaagaaaucccagccccccuaggaacuccagauuucguggggaagauucaagguaugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcuuccaagcuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7876 - RNA, 1617 nt, Artificial Sequence
  VP1__Norovirus_and/or_Norovirus-like__KC517376
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaagucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguccacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucagggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7877 - RNA, 1617 nt, Artificial Sequence
  VP1__Norovirus_and/or_Norovirus-like__KC517374
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccaccuacaguugagucaagaacuaaaccauucucugucccaguuuuaacuguugaggagaugaccaauucaagauuccccaucccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaccccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacauucugauguggcucugcuaagauuugugaacccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaguggaacggggcguagacguuaa

SEQ ID NO: 7878 - RNA, 1617 nt, Artificial Sequence
  VP1__Norovirus_and/or_Norovirus-like__KC409308
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauucccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcagaugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggaaccacccaccgaaaugaaccccaacaauggaugcucccaaguuauucagguagagauguucauaauguacaccuagccccugcuguagcccccacuuuuccgggugaacaacuucuuuucuucagguccaccaugcccggaugcagcggguaucccaacauggauuuggauugccuacucccccaggagugggugcagcacuucuaccaagaggcagcuccagcacaaucugauguggcucuacugagauuugugaauccagacacggguaggguccuguuugagugcaaacuucauaaaucagguuaugucacaguggcucacaccggucagcaugauuuggucaucccccccaauggcuauuuuagguuugauuccuggguuaaucaauucuacacacuugcccccaugggaaacggaacggggcguaggcgcuaa

SEQ ID NO: 7879 - RNA, 1617 nt, Artificial Sequence
  VP1__Norovirus_and/or_Norovirus-like__KC175393
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaauuguucacgggccccagcggugccuuuguuguccaaccacaaaauggcaggugcacgacugauggcgugcucuuaggcaccacccaacugucuccugucagcaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagcccccgcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7880 - RNA, 1617 nt, Artificial Sequence
  VP1__Norovirus_and/or_Norovirus-like__JX459623
augaagauggcgucgaaugaccccaacccaucugauggguccgcagccaaccucgucccagaggucaacaaugagguuauggcucuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcaggcacucguaauuacacaaugaauuuggcuucucuaaauuggaacaauuacgacccaacagaagaaauuccagccccucuaggaacuccagauuucgugggaaagauccaaggugugcuuacucaaaccacaaagggggauggcucgacucguggccauaaagcuacaguuuacacugggagugcccccuuuacuccaaagcugggcaguguucaauucaguacugauacagaaaaugauuuugaaacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7881 - RNA, 1617 nt, Artificial Sequence
  VP1__Norovirus_and/or_Norovirus-like__JQ798158
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggccccgaucugaaucccuaccuugcucauuuggccagaauguacaauggcuaugcagguggcuuugaagugcagguaauccuugcggggaaugcguucaccgccggaaaaaucauauuugcagcagucccaccaaauuucccaacugaaggcuugagccccagccaggucacuauguucccccauauaguaguagauguuaggcaacuggaaccuguguugauccccuuaccugauguugggaacaauuucuaucauuacaaccaaucaaaugaccccaccauuaaacugauagcaaugcuguacacaccacuuagggcuaauaaugcuggggaagaugucuuuacagucucuugucgaguccucacgaggccaucucccgauuuugauuucauauuuuuggugccacccacaguugagucaagaacuaaaccauucaccgucccaaucuuaacuguugaggaaaugaccaauucaagauuccccauuccuuuggaaaaguuguucacggguccuagcggugccuuuguuguucaaccacaaaauggcaggugcacgacugauggcgugcuuuuaggcacuacccaacugucuccugucaacaucugcaccuucagaggggaugucacccacauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucaccccaaagcugggcaguauucaguucaacacugauacaaacaaugauuuugaaacuggccaaaacacgaaauucaccccagucgguguuguccaggaugguaauggugcccaccaaaaugaaccucaacaaugggugcucccaagcuacucagguagaacuggucauaauguacacuuagcccccgccguagcccccacuuuuccgggugagcaacuucuuuucuucagguccacuaugcccgggugcagcggguacccuaacaugaauuuggauugucuacucccccaagaaugggugcagcacuucuaccaagaggcagccccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7882 - RNA, 1617 nt, Artificial Sequence
  VP1__Norovirus_and/or_Norovirus-like__JQ613566
augaagauggcgucgagugacgccaacccaucugauggguccacagccaaccucgucccagaggucaacaaugagguuauggcucuggagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccauauaauaguagauguuaggcaauuggaaccuguguugauccccuuacccgauguuaggaauaauuucuaccacuauaaucaaucaaaugaccccaccaucaaauugauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccguuccuuuggaaaaguuguuuacgggccccaguagugccuuuguuguucaaccacaaaacggcaggugcacgacugauggcgugcuccuagguacuacccaacuguccccugucaacaucugcaccuucagaggggaugucacccauauuccaggcagucguaacuacacaaugaauuuagccucccaaaauuggaacaguuacgauccaacagaagaaaucccagccccucuaggaacuccagauuucguggggaagauucaaggugugcucacccaaacaacaaggacaaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguacuaccccccgaaaugaaccccaacaaugggugcucccaaguuacucaggcaggaacauucauaaugugcaccuggcccccgcuguggcccccacuuucccgggcgagcagcuucucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuaugucacaguggcucacacuggccaacaugauuugguuaucccccccaaugguuauuuuagauuugauuccuggguuaaccaguucuacacacuugcccccaugggaaaugggacggggcguaggcguuaa

SEQ ID NO: 7883 - RNA, 1617 nt, Artificial Sequence
  VP1__Norovirus_and/or_Norovirus-like__AB541287
augaagauggcgucgaaugacgccaacccaucugauggguccgcagccaaccucgucccagaggucaacaaugagguuauggcuuuggagcccguugucggugcugcuauugcggcgccuguagcgggccaacaaaauguaauugaccccuggauuagaaauaauuuuguacaagccccugguggagaguucacaguaucuccuaggaacgcuccaggugaaauacuauggagcgcucccuuaggcccugaucugaaucccuaccuaucucauuuggccagaauguauaaugguuaugcaggugguuuugaagugcaggugguccucgcggggaacgcguucaccgccggaaaaguuauauuugcagcagucccaccaaauuuuccaacugaaggcuugagccccagucaggucacuauguucccccacauaauaguagauguuaggcaauuggagcccguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaacucaagauucccuauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggaguacccccuuuacuccaaagcugggcaguguucaauucagcacugauacagaaaaugauuuugaaaaucaccaaaacacaaaauuuaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguauccuaacauggaucuggauugccuacucccccaggaguggguacagcacuucuaccaagaggcagcuccagcacaaucugauguggcucuacugagauuugugaauccagauacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7884 - RNA, 1617 nt, Artificial Sequence
  VP1__Norovirus_and/or_Norovirus-like__AB504320
augaagauggcgucgaaugacgccaacccaucugauggguccgcagccaaccucgucccagaggucaacaaugagguuauggcucuggagcccguugccggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggagccuguguugauccccuuaccugauguuaggaauaacuucuaucacuauaaucagucaaaugauucuaccauuaaauugauagcaaugcuguacacaccacuuagggcuaauaaugcuggggaagaugucuucacagucucuugucgaguccucacgaggccauccccugauuuugauuuuauauuuuuggugccaccuacaguugagucaagaaccaaaccauuuacugucccaaucuuaacuguugaagaaaugaccaauucaagauuccccauuccuuuggaaaaguuguucacgggucccagcggugccuuuguuguucaaccacaaaauggcagaugcacuacugauggcgugcucuuaggcaccacccaacugucuccugucaacaucugcaccuucagaggggaugucacccacauugcaggcacucguaauuacacaaugaauuuggcuucucuaaauuggaacaacuacgacccaacagaagaaauuccagccccucuaggaacuccagauuucgugggaaagauccaaggugugcucacucaaaccacaaagggggauggcucgacccguggccauaaagcuacaguuuacacugggagugcccccuuuacuccaaagcugggcaguguucaauucaguacugauacagaaaaugauuuugagacucaccaaaacacaaaguucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggacuuggauugccuacucccccaggagugggugcagcacuucuaccaagaggcagcuccagcacaaucugauguggcucuaaugagauuugugaauccagacacggguagaguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7885 - RNA, 1617 nt, Artificial Sequence
  VP1__Norovirus_and/or_Norovirus-like__KU683739
augaagauggcgucgagugacgccaacccaucugauggguccgcagccaaccucgucccagaggucaacaaugagguuauggcucuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuccuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcaugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuuuagguuugauuccugggucaaccaguuuuacacgcuugcccccaugggaaauggaacggggcguagacguuaa

SEQ ID NO: 7886 - RNA, 1617 nt, Artificial Sequence
  VP1__Norovirus_and/or_Norovirus-like__KX354146
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaauaauuuuguacaagccccugguggggaguuuacaguauccccuagaaacgcuccaggugaaauacuauggagcgcgccccuaggcccugaccuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaaguccuagccaggucacuauguucccccauauaauaguggauguuagacaauuagaaccugugcugauucccuuacccgaugucaggaauaauuucuaucauuacaaucagucaaaugaucccacuauuaaguugauagcaauguuguauacaccacuuagggcuaauaaugcuggggaugauguuuucacaguuucgugccgaguucucacgagaccaucccccgauuuugauuucauauuuuuagugccacccacaguugagucaagaacuaaaccauucucugucccaguuuuaacuguugaggagaugaccaauucaagacuccccauuccuuuggaaaaguuguucacgggccccagcagugccuuuguuguucaaccacaaaacggcaggugcacaacugauggcgugcuccuaggcaccacccaacugucuccugucaacaucugcaccuucagaggggaugucacccacaucacagguagucgcaacuacacaaugaauuuggcuucucaaaauuggaacaacuaugacccaacagaagaaaucccagccccucuaggaacuccagauuuuguggggaagauucaaggcaugcucacccaaacuacaagaacagaugguucaacacgcggucacaaagcuacaguguacacugggagcgccgacuuugcuccaaaacuggguaggguucaauuugaaacugacacagaccaugauuuugaagcuaaucaaaacacaaaguucaccccagucggugucauccaagaugguagcaccacccaccgaaacgaaccccaacagugggugcucccaaguuacucaggcagaaauacucacaauguacaucuggcccccgcuguagcccccaccuuuccgggugaacaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguuaa

SEQ ID NO: 7887 - RNA, 1617 nt, Artificial Sequence
  VP1__Norovirus_and/or_Norovirus-like__KX354075
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugagauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuuuccaacugaagguuugagccccagccaagucacuauguucccccacauaauaguagauguuaggcaauuggaaccuguguugauccccuuacccgaugucaggaauaauuucuaccacuauaaucagucaaaugaccccacuaucaaauugauagcaauguuguacacaccacuuagggcuaacaaugccggggaugaugucuucacaguuucuugucgaguucucacgagaccaucccccgauuuugauuucauauuuuuggugccacccacaguugaaucaagaaccaaaccauucucugucccaguuuuaacuguugaggagaugaccaauucaagguuccccauuccucuggaaaaguuguucacgggccccaguagugccuuuguuguucaaccacaaaacggcaggugcacgacugauggcgugcuccuagguacuacucaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauucgccacugacacagacaaugauuuuguaaccaaccaaaacacaaaguucaccccagucgguguuauccaggaugguaguacuaccccccgaaaugaaccccaacaaugggugcucccaaguuacucaggcagaaacgcucauaaugugcaucuggcccccgcuguagcccccacuuucccgggcgagcagcuucucuucuucagauccaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7888 - RNA, 1617 nt, Artificial Sequence
  VP1__Norovirus_and/or_Norovirus-like__KX354072
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggccccgaucugaaucccuacuuaucucauuuggccagaauguauaaggguuaugcaggugguuuugaagugcaggugauccucgcggggaacgcguucaccgccggaaaaauuauauuugcagcagucccaccaaauuuuccaacugaaggcuugagucccagccaggucacuauguuuccccauauaauaguagauguuaggcaauuggaaccuguguugauccccuuaccugauguuaggaauaauuucuaucauuauaaucagucaaaugauuccaccauuaaguugauagcaaugcuguauacaccaccuagggccaacaaugccggggaugaugucuucacagucucuugucgaguccucacgaggccauccccugauuuugacuucauauuuuuggugccaccuaccguugagucaagaacuaagccauuuacugucccaaucuugacuguugaagaaaugaccaauucaagauuccccauuccuuuggaaaaauuguucacgggucccagcagcgccuuuguuguucaaccacaaaauggcagaugcacgacugauggcgugcucuuaggcaccacccaacugucuccugucaacaucugcaccuucagaggggaugucacccacauugcggguucucguaauuacacaaugaauuuggccucuuuaaauuggaacaauuaugacccaacagaagagauuccagccccucuggggacuccagauuucgugggaaagauccaaggugugcucacucaaaccacaaagggagauggcucgacccggggucauaaagcuacaguuuacacugggagugccgacuuuacuccaaagcugggcaguguucaauuugcuacugacacagaaaaugauuuugaaacucaccaaaacacaagauucacaccagucggugucauccaggaugguagcaccacccaccgaaaugaaccccaacaaugggugcuuccaaguuauucagguagaaauguccauaauguacaccuagccccugcuguagcccccaauuuuccgggugaacaacuucuuuucuucagguccaccaugcccggaugcagcggguaucccaacauggacuuggauugccuacucccccaggagugggugcagcacuucuaccaagaggcagcuccagcacaaucugauguggcucuauugagauuugugaauccagacacggguagggucuuguuugagugcaagcuucauaaaucaggcuaugucacaguggcucacaccggccaacaugauuuggucaucccccccaaugguuauuuuagguuugauuccuggguuaaucaauucuauacacuugcccccaugggaaauggaacggggcguagacgauaa

SEQ ID NO: 7889 - RNA, 1617 nt, Artificial Sequence
  VP1__Norovirus_and/or_Norovirus-like__KX354060
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggcuagaauguacaaugguuaugcaggugguuuugaagugcaggugauccucgcggggaacgcguucaccgccgggaaaaucauauuugcagcagucccaccaaauuucccaacugaagguuugagccccagccaggucacuauguucccacacauaauaguagauguuaggcaauuggaaccuguguugauccccuuacccgauguuaggaauaauuucuaucauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauucccuuggaaaaguuguucacgggccccaguagugccuuuguuguucaaccacaaaacgguaggugcacgacugauggcgugcuccuagguaccacucaacugucuccugucaacaucugcaccuucagaggggaugucacccauauuccaggcagucauaacuacacaaugaauuuggccucccaaaauuggaacaguuacgacccaacagaagaaaucccagccccucuaggaaccccagauuucguggggaagauucaaggugugcucacucaaaccaccaguacaaauggcucgacccgcggccacaaagcuacaguguacacugggagcgccgacuuuucuccaaaacuggguagaguucaauuugccacugacacaaacaaugauuuugaaacuaaccaaaacacaaaauucaccccagucggcguuauccaggaugguaguaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggaccuagauugucugcucccccaggaaugggugcagcacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccuggguuaaccaguucuacacacuugcccccaugggaaaugggacggggcguagacguuaa

SEQ ID NO: 7890 - RNA, 1617 nt, Artificial Sequence
  VP1__Norovirus_and/or_Norovirus-like__KX353959
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugcuggggacgaugucuucacaguuucuugucgaguucucacgagaccaucccccgauuuugacuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauaucccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuuccccaaaacuggguagaguucaauuugccacugacacagacaaugauuuugaaacuaaccaaaacacaaaguucaccccagucgguguuauccaggaugguagugccaccccccggaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugacuccugggucaaccaguucuacacacuugcccccaugggaaaugggacggggcguagacguuaa

SEQ ID NO: 7891 - RNA, 1617 nt, Artificial Sequence
  VP1__Norovirus_and/or_Norovirus-like__KX353954
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaauuauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaccaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaucaaaacacaaaguucaccccagucggugucauccaggaugguaguacuaccccccgaaaugaaccccaacaaugggugcucccaaguuacucaggcagaagcauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagauacagguaggguuuuguuugaguguaagcuucauaaaucaggcuauguuacaguggcucacacuggccaacaugauuugguuaucccccccaaugguuauuuuagauuugauucuugggucaaccaguucuacacacuugcccccaugggaaaugggacggggcguagacguuaa

SEQ ID NO: 7892 - RNA, 1617 nt, Artificial Sequence
  VP1__Norovirus_and/or_Norovirus-like__AB972529
augaagauggcgucgagugacgccaacccaucugauggguccgcagccaaccucgucccagaggucagcaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacucauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7893 - RNA, 1617 nt, Artificial Sequence
  VP1__Norovirus_and/or_Norovirus-like__AB972504
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccaggauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccagucuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagacgucacccauaucacagguagucguaacuacacaaugaauuuggcuucucaaaauuggagcaauuaugacccaacagaagaaaccccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7894 - RNA, 1617 nt, Artificial Sequence
  VP1__Norovirus_and/or_Norovirus-like__AB972503
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccaggauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccagucuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagacgucacccauaucacagguagucguaacuacacaaugaauuuggcuucucaaaauuggagcaauuaugacccaacagaagaaaccccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7895 - RNA, 1617 nt, Artificial Sequence
  VP1__Norovirus_and/or_Norovirus-like__KP244322
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuguggagcgcgcccuuaggcccugauuugaaucccuaccuuucccauuuggccagaauguacaaugguuaugcagguggcuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaauaaugcccgggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccucuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagagaucccagccccccuaggaacuccagauuucguggggaagauucaaggugugcucacccaaaccacaaggacagaugguucgacccgcggccacaaagcuacaguguacacugggagcgccgacuuuucuccaaaacuggguaggguucaauuugccacugacacagacaaugauuuugaaacuaaccaaaacacaaaguucaccccagucgguguuauccaggauggugguaccacccaccgaaaugaaccccaacaaugggugcucccaaauuacucaggcagaaacacucauaaugugcaccuggcccccgcuguagcccccacuuucccgggcgagcagcuccucuucuucagaucuaccaugcccggaugcagcggguaccccaacauggauuuggacugccugcuuccccaggaaugggugcaguauuucuaccaggaggcagccccagcacaaucugauguggcacuguuaagauucgugaauccagauacagguaggguuuuguuugaguguaagcuucauaaaucagguuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7896 - RNA, 1617 nt, Artificial Sequence
  VP1__Norovirus_and/or_Norovirus-like__LC018706
augaagauggcgucgagugacgccaacccauccgauggguccgcagccaaccucgucccagaggucaacaaugaggauauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuggguccugaucuaaaucccuaccuaucccaucuggccagaauguacaaugguuaugcaggugguuuugaagugcagguaauucucgcggggaacgcguucaccgccgggaaggucauauuugcagcagucccaccaaauuuuccaacagaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaauaaugcuggggaugaugucuucacaguuucuugccgaguccucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaauggcaggugcacgacugauggcgugcuccuaggcaccacccaacugucuccugucaacaucugcaccuucagaggagaugucacccacaucacagguagucguaacuacacaaugaauuuggcuucucaaaauuggaacaauuaugacccaacagaagaaaucccagccccucuaggaaccccagauuuuguggggaagauucaaggcgugcucacccaaaccacaaggacagaugguucaacacgcggccacaaagcuacaguguauacugggagcgccaauuuuucuccaaaacuggguagaguucaauuugaaacugauacagaccaugauuuugaaguuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuuaguuaucccccccaaugguuauuuuagguuugauuccugggucaaccaguuuuacacgcuugcccccaugggaaauggaacggggcguaggcguuaa

SEQ ID NO: 7897 - RNA, 1617 nt, Artificial Sequence
  VP1__Norovirus_and/or_Norovirus-like__KP096345
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauauuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggccugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggggcaauuaugacccaacagaagagaucccagccccucuaggaacuccagauuuuguggggaagauucaaggcgugcucacccaaacuacaaggacagauggcucaacacguggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7898 - RNA, 1617 nt, Artificial Sequence
  VP1__Norovirus_and/or_Norovirus-like__KM982939
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguuaauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuccuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaggaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcuuacacuggccaacaugauuugguuaucccccccaaugguuauuuuagguuugauuccugggucaaccaguuuuacacgcuugcccccaugggaaauggaacggggcguagacguuaa

SEQ ID NO: 7899 - RNA, 1617 nt, Artificial Sequence
  VP1__Norovirus_and/or_Norovirus-like__KM198588
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaacuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggcgcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7900 - RNA, 1617 nt, Artificial Sequence
  VP1__Norovirus_and/or_Norovirus-like__KM198544
augaagauggcgucgagugacgccaacccguccgauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccaggauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccaccuaauaguagauguuaggcaauuggaaccuguguugauucccuuacccgauguuaggaauaauuucuaccauuacaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauucccuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuucagguagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugagccccaacaaugggugcucccaaguuacucaggcagaaacauucacaaugugcaccuggcccccgcuguagcccccacuuucccgggcgagcagcuccucuucuucagaucuacuaugcccgggugcagcggguaccccaacauggacuuggacugucugcucccccaggaaugggugcaguauuucuaccaggaggcagccccagcacaaucugauguggcucuguuaagauuugugaacccggauacagguaggguuuuguuugaguguaagcuucauaaaucaggcuauguuacaguggcucacacuggccaacaugauuuaguuaucccccccaaugguuauuuuagauuugauuccugggucaaccaauucuacacacuugcccccaugggaaaugggacggggcguagacguuaa

SEQ ID NO: 7901 - RNA, 1617 nt, Artificial Sequence
  VP1__Norovirus_and/or_Norovirus-like__KM198522
augaagauggcgucgaaugacgccaacccaucugauggguccgcagccaaccucgucccagaggucagcaaugagguuauggcuuuggaacccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcgggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagacaaaugauucuaccauuaaauugauagcaaugcuguauacaccacuuagggccaauaaugcuggggaagaugucuuuacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7902 - RNA, 1617 nt, Artificial Sequence
  VP1__Norovirus_and/or_Norovirus-like__KM198508
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggagccuguguugauccccuuaccugauguuaggaauaauuucuaucauuauaaucagacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcacuuucagaggggaugucacccacauugcagguucucguaacuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggucauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugaugcggcucuauugagauuugugaauccagacacggguaggguccuguuugagugcaaacuucauaaaucaggcuaugucacaguggcucacaccggucagcaugauuuggucaucccccccaauggcuacuuuagguuugauuccuggguuaaucaguucuacacgcuugcccccaugggaaacggaacggggcguaggcgcuaa

SEQ ID NO: 7903 - RNA, 1617 nt, Artificial Sequence
  VP1__Norovirus_and/or_Norovirus-like__KJ716367
augaagauggcgucuagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguauaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7904 - RNA, 1617 nt, Artificial Sequence
  VP1__Norovirus_and/or_Norovirus-like__KF177440
augaagauggcgucgagugacgccaacccaucugauggguccgcagccaaccucguuccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuagggacuccagauuuuguggggaaaauucaaggugugcucacccaaaccacaagaacagauggcucaacacguggccacaaagcuacaguguacacugggagcgccgauuuugcuccaaaacuggguagaguucaauuugaaacugacacagaccaugauuuugaagcuaaccaaaacacaaaguucaccccaguuggugucauccaagaugguggcaccacccaccggaaugaaccccaacagugggugcucccaaguuauucaggcagaaauacuccuaaugugcaccuggccccugcuguagcccccacuuuuccgggugagcaacuucucuucuucagauccaccaugcccggaugcagcggguaccccagcauggauuuggacugucugcucccccaggaaugggugcaguacuucuaccaagaggcagccccagcacaaucugauguggcucugcuaagauuugugaauccagacacagguaggguuuuguuugaguguaagcuccauaaaucaggcuauguuacgguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7905 - RNA, 1617 nt, Artificial Sequence
  VP1__Norovirus_and/or_Norovirus-like__KF060117
augaagauggcgucgagugacgcccacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaucccacuaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuauucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagaaaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucggugucauccaggaugguagcacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcgcuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7906 - RNA, 1617 nt, Artificial Sequence
  VP1__Norovirus_and/or_Norovirus-like__KF060104
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaguuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuaugauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7907 - RNA, 1617 nt, Artificial Sequence
  VP1__Norovirus_and/or_Norovirus-like__KF060095
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuucguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuguucacgggccccaguggugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagagaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacagugauuuuguaacuaaccaaaacacaaaguucaccccagucgguguuauccaggaugguagcaccaccccccgaaaugaaccucaacaaugggugcuuccaaguuacucaggcagaagcacucauaaugugcaccuggcccccgcuguggcccccacguucccgggugagcagcuccucuucuucagaucuaccaugcccggaugcagcggguaccccaacauggauuuggacugucugcucccccaagaaugggugcaguauuucuaccaggaggcagccccagcgcaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7908 - RNA, 1617 nt, Artificial Sequence
  VP1__Norovirus_and/or_Norovirus-like__KF060084
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagccguaacuacacaaugaauuuggccucccaaaauuggaacaguuacgauccaacagaagaaaucccagccccccuaggaacuccagauuucgugggaaagauucaagguguacucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaauauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaauggagcggggcguagacguuaa

SEQ ID NO: 7909 - RNA, 1617 nt, Artificial Sequence
  VP1__Norovirus_and/or_Norovirus-like__KF060082
augaagauggcgucgagugacgccaacccaucugauggguccacagccaaucucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaaccccagauuucguggggaagauucaaggugugcucacccaaaccacaaggacaaauggcucaacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuucauaaaucaggcuauguuacaguggcucacacuggccaauaugauuugguuaucccccccaaugguuauuuuagauuugauuccugggucaaccaguucuacacacuugcccccaugggaaaugggacggggcguagacguuaa

SEQ ID NO: 7910 - RNA, 1617 nt, Artificial Sequence
  VP1__Norovirus_and/or_Norovirus-like__KF060079
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuagaaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaguaguuaugauccaacagaagaaaucccagccccccuaggaacuccagauuucguggggaagauucaaggugugcucacccaaaccacaaggacagacggcucgacccgcggccacaaagcuacaguguacacugggagcgcugacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaagcuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucagguuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7911 - RNA, 1617 nt, Artificial Sequence
  VP1__Norovirus_and/or_Norovirus-like__KF060058
augaagauggcgucgagugacgccaacccaucugauggguccacagccaaccucgucccagaggucaacaaugagguuauggcuuuggagcccguaguuggugccgccauugcggcaccuguagcgggccagcaaaauguaauugaccccuggauuagaaacaauuuuguacaagccccugguggagaguuuacaguauccccuagaaacgcuccaagcacaauacuauggagugcgcccuuaggccccgauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccacuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguauacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuaccaugcccgggugcagcggguaccccaacauggauuuggacugucugcucccccaggaaugggugcaguauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7912 - RNA, 1617 nt, Artificial Sequence
  VP1__Norovirus_and/or_Norovirus-like__KF060039
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaaugcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaucauuauaaucagucaagugaccccaccaucaaauugauagcaauguuguauacaccacuuagggcuaacaaugccggggacgaugucuucacaguuucuugucgaguucucacgagaccaucccccgauuuugauuucauauuuuuagugccacccacaguugaaucaagaacuaaaccauucucugucccaguuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagagaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauucaggaugguaguacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7913 - RNA, 1617 nt, Artificial Sequence
  VP1__Norovirus_and/or_Norovirus-like__KF060030
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggaacgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaauugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuugugggaaagauucaaggcgugcuuacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacuguuugcucccccaggaaugggugcaguacuucuaccaagaggcagcuccagcacaaucugauguggcucugcuaagauuugugaauccagacacagguaggguuuuguuugaguguaagcuucauaaaucaggcuaugcuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7914 - RNA, 1617 nt, Artificial Sequence
  VP1__Norovirus_and/or_Norovirus-like__JX439829
augaagauggggucgaaugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaccccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagccaugcuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacguuaa

SEQ ID NO: 7915 - RNA, 1617 nt, Artificial Sequence
  VP1__Norovirus_and/or_Norovirus-like__KC409282
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaacucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaacuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucacaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaccaguucuacacgcuugcccccaugggaaacggaacggggcguaggcgcuaa

SEQ ID NO: 7916 - RNA, 1617 nt, Artificial Sequence
  VP1__Norovirus_and/or_Norovirus-like__KC409259
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaucuaucccauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucaaacaaaugauucuaccauuaaauugauagcaaugcuguauacaccacuuagggccaauaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugccuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagaaaaugauuuugaaacucaccaaaacacaaaauucaccccagucggugucauccaggaugguggcaccacccaccgaaaugaaccccagcaaugggugcucccaaguuauucagguagagauguucauaauguacaccuagccccugcuguggcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaccaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7917 - RNA, 1617 nt, Artificial Sequence
  VP1__Norovirus_and/or_Norovirus-like__JX459659
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuucgaagugcagguaauccucgcggggaaugcguucaccgccgggaaaaucauauuugcagcagucccaccaaauuucccaacugaagguuugagccccagccaagucacuauguucccccacauaguaguagauguuaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagauaaugauuuuguaacuaaccagaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccgggugcagcggguaucccaacauggauuuggacugucugcucccccaggaaugggugcaguauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7918 - RNA, 1617 nt, Artificial Sequence
  VP1__Norovirus_and/or_Norovirus-like__JX459658
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuguggagcgcgcccuuaggcccugauuugaaucccuaccuuucccauuuggccagaauguacaacgguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuauuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucagguuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7919 - RNA, 1617 nt, Artificial Sequence
  VP1__Norovirus_and/or_Norovirus-like__JX459595
augaagauggcgucgaaugacgccaccccaucugauggguccacagccaaccucgucccagaggucaacaaugagguuauggcuuuggagcccguuguuggugccgcgauugcggcaccuguagcgggccaacaaaauguaauugaccccuggauuagaaauaauuuuguacaagccccugguggagaguucacaguauccccuagaaacgcuccaggugaaauauuauggagcgcgcccuugggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaauaauuucuaucauuauaaucaaucaaaugacuccaccaucaaauugauaccaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuaucccuuuggaaaaguuguucacgggucccagcagugccuuuguuguucaaccacaaaauggcagaugcacgacugauggcgugcucuuagguacuacccaacugucuccugucaacaucugcaccuucagaggggaugucacccacauugcagguacucaaaguuacacaaugaaucuggccucccaaaauuggaacaauuaugacccaacagaagaaaucccagccccucugggaaccccagauuuuguaggaaagauccaaggcgugcucacucaaaccacaaggggggauggcucgacccgcggucacaaagccacagugagcacuggaaguguccacuuuaccccaaagcugggcaguguucaauucuccacugauacaagcaaugacuuugaaacuggccaaaacacgagauucaccccagucggugucguccaggaugguaguaccacccaccaaaaugaaccccaacaaugggugcucccaaacuauucagguagagauagucacaauguacaccuagccccugccguggcccccacuuuuccgggugagcaacuucuuuucuuuagguccacuaugcccggaugcagcggguaucccaacaugaauuuggauugccuacucccccaggagugggugcagcacuucuaccaagagucagccccagcacaaucugauguggcacugcugagauuugugaauccagacacagguaggguuuuguuugagugcaagcuucauaaaucaggcuauguaacaguggcucacacuggccaacaugauuugguuaucccccccaauggcuauuuuagauuugauuccugggucaaucaauucuacacacuugcccccaugggaaauggagcggggcguagacguuaa

SEQ ID NO: 7920 - RNA, 1617 nt, Artificial Sequence
  VP1__Norovirus_and/or_Norovirus-like__JQ613560
augaagauggcgucgagugacgccaacccaucugauggauccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaagggcaaauggcucgacccgcggccacaaagcuacaguguacacugggagcgccgacuuuucuccaaaacuggguagaguucaauuugccacugacacagacaaugauuuugaaacuaaccaaaacacaaaguucaccccaguugguguuauccaggaugguaguaccaccccccgaaaugaaccccaacaaugggugcucccaaguuacucagguagaaacauucacaaugugcaccuggcccccgcuguagcccccacuuucccgggcgagcagcuccucuucuuuagaucuacuaugcccggaugcagcggguaccccaacauggacuuggacugucugcuaccccaggaaugggugcaguauuucuaccaggaggcagccccagcacaaucugauguggcucugcuaagauuugugaauccggacacagguaggguuuuguuugaguguaagcuucauaaaucaggcuauguuacaguagcucacacuggccaacaugauuugguuaucccccccaaugguuauuuuagauuugauuccugggucaaccaguucuacacacuugcccccaugggaaaugggacggggcguaggcguuaa

SEQ ID NO: 7921 - RNA, 1617 nt, Artificial Sequence
  VP1__Norovirus_and/or_Norovirus-like__JQ613545
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaauuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccacuuucccgggcgaacagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7922 - RNA, 1617 nt, Artificial Sequence
  VP1__Norovirus_and/or_Norovirus-like__AB541288
augaagauggcgucgaaugacgccaacccaucugauggguccgcagccaaccucgucccagaggucaacaaugagguuauggcuuuggagcccguugucggugcugcuauugcggcgccuguagcgggccaacaaaauguaauugaccccuggauuagaaauaauuuuguacaagccccugguggagaguucacaguaucuccuaggaacgcuccaggugaaauaccauggagcgcucccuuaggcccugaucugaaucccuaccuaucucauuuggccagaauguauaaugguuaugcaggugguuuugaagugcaggugguccucgcggggaacgcguucaccgccggaaaaguuauauuugcagcagucccaccaaauuuuccaacugaaggcuugagccccagucaggucacuauguucccccacauaauaguagauguuaggcaauuggagcccguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaacucaagauucccuauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaacuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggaguacccccuuuacuccaaagcugggcaguguucaauucagcacugauacagaaaaugauuuugaaaaucaccaaaacacaaaauuuaccccagucggugucauccaggaugguggcaccacccaccgaaaugaaccccaacaaugggugcucccaaguuauucagguagaaauguccaaaauguacaccuagccccugcuguagcccccacuuuuccgggugaacaacuucuuuucuucagguccacuaugcccggaugcagcggguauccuaacauggaucuggauugccuacucccccaggaguggguacagcacuucuaccaagaggcagcuccagcacaaucugauguggcucuacugagauuugugaauccagauacggguaggguccuguuugagugcaaacuccauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 7923 - RNA, 1617 nt, Artificial Sequence
  VP1__Norovirus_and/or_Norovirus-like__AB541247
augaagauggcgucgaaugacgccaaccgaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccgacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuuuagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaagugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaaugguuauuuuagguuugauuccugggucaaucaauucuauacacuugcccccaugggaaauggaacggggcguagacguuaa

SEQ ID NO: 7924 - RNA, 1617 nt, Artificial Sequence
  VP1__Norovirus_and/or_Norovirus-like__EU839585
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaagaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugauuccaccauuaaauugauagcaaugcuguacacaccacuuagggcuaauaaugcuggggaugaugucuucacagucucuugccgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccagguacucguacuuacagaaugaauuuggcuucucaaaauuggaacaauuaugacccaacagaagagaucccagccccucugggaacuccagauuucgugggaaagauccaaggcaugcucccccaaaccacaaagggagacggcucaacccgcggucacaaagcuacagugagcacugggaguguugacuuuacuccaaagcugggcagcguucaguucgccacugauacagacaaugauuuugaaacuggccagaacacaagguucaccccagucggugucauccaggaugguaguaguacccacagaaaugaaccccaacaauggguacucccagauuacucagguagaacuguuuauaauguacaccuggccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggucagcaugauuugguuaucccccccaauggcuauuuuagauuugauuccugggucaaccaguucuacacacuugcccccaugggaaauggagcggggcguagacguuaa

SEQ ID NO: 7925 - RNA, 1617 nt, Artificial Sequence
  VP1__Norovirus_and/or_Norovirus-like__AY588021
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaccauuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuucuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugaugguguacucuuaggcacuacccaacugucuccugucaacaucugcaccuucagaggggaugucacccauauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcuaggcaguauucaguucaacacugauacaaacaaugauuuugaaacuggccaaaacacgagauucaccccaguugguguuguccaggaugguaauggcacccaccaaaaugaaccucaacaaugggugcucccaagcuacucagguagaacuggucauaauguacaccuagcccccgccguagcccccacuuuuccgggugagcaacuucuuuucuucagguccacuacgcccggaugcagcggguaccccaacaugaauuuggauuguuuacucccccaagaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7926 - RNA, 1617 nt, Artificial Sequence
  VP1__Norovirus_and/or_Norovirus-like__KX514188
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggauaaauuauucacgggacccagcagugccaauguuguucaaccacaaaauggcaggugcacgauugauggcgagcucuuaggcaccacccaacugucuccuguuaacauuugcaccuucagaggggaugucacccacccuagggacucucaaauuuacacaaugaauuuggccucuccaaauuggaacaauuaugacccaacagaagagaucccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 7927 - RNA, 1617 nt, Artificial Sequence
  VP1__Norovirus_and/or_Norovirus-like__KX354101
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggggaguuuacaguauccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaacuagaaccuguguugauucccuuacccgauguuaggaauaauuucuaucauuauaaucaaucaaaugaccccaccauuaagcugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagacgucacccauaucacagguagucguaacuauacaaugaauuuggcuucucaaaauuggaacaauuaugacccaacagaagaaaccccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccagucggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggacuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucauacuggccaacaugauuugguuauuccccccaaugguuauuuuagauuugauuccugggucaaccaguucuacacgcuugcccccaugggaaauggaacggggcguagacguuaa

SEQ ID NO: 7928 - RNA, 1617 nt, Artificial Sequence
  VP1__Norovirus_and/or_Norovirus-like__KX354023
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaacuuuccaacugaaggcuugagccccagccaggucacuauguucccccauauaguaguagauguuaggcaacuagaaccuguguugauucccuuacccgauguuaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcacaacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagacuuuguggggaagauucaaggcaugcucacccaaaccacaagggcagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguagcaccacccaccgaaaugaaccccaacagugggugcucccaaguuacucaggcagaaauacucauaaugugcaucuggcccccccuguagcccccacuuuuccgggugagcaacuccucuucuucagauccaccaugcccggaugcagcggguacccuaacauggauuuggacugucugcucccccaggaaugggugcaguacuucuaccaagaggcagcccccgcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 7929 - RNA, 1617 nt, Artificial Sequence
  VP1__Norovirus_and/or_Norovirus-like__KX353979
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacaugauaguagauguuaggcaauuggaaccuguguugauucccuuacccgauguuaggaauaauuucuaccauuauaaucaaucaaaugaccccaccaucaaauugauagcaaugcuguacacaccacuuagggcuaauaaugccggggacgaugucuucacaguuucuugucgaguccucacgagaccaucccccgauuuugauuucauauuuuuggugccacccacaguugaaucaagaacuaaaccauuuucugucccaguuuuaacuguugaggagaugaccaauucaagguuccccauuccuuuggaaaaguuguucacgggccccaguagugccuuuguuguucaaccacaaaacggcaggugcacgacugauggcguacuccuagguacuacccaacugucuccugucaacaucugcaccuucagaggggaugucacccauaucucaggcagucguaacuacacaaugaauuuggcuucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguacccuaacauggauuuggacugucugcucccccaggaaugggugcaguauuucuaccaggaggcagccccagcacaaucugauguggcucuguugagauuugugaauccagauacagguaggguuuuguuugaguguaagcuccauaaaucaggcuauguuacaguggcucacacuggccaacacgauuugguuaucccccccaaugguuauuuuagauuugauuccugggucaaccaguucuacacacuugcccccaugggaaaugggacggggcguagacguuaa

SEQ ID NO: 7930 - RNA, 1617 nt, Artificial Sequence
  VP1__Norovirus_and/or_Norovirus-like__AB972491
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccacauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggacccagcagugccuuuguuguccaaccacaaaacgguaggugcacgacugauggcgugcuccuaggcaccacccaacugucuccugucaacaucugcaccuucagaggagaugucauccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugggaaauggaacggggcguagacguuaa

SEQ ID NO: 7931 - RNA, 1617 nt, Artificial Sequence
  VP1__Norovirus_and/or_Norovirus-like__AB972469
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaaucuuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgacuuugauuucauauuucuagugccacccacaguugagucaagaacuaaaccauucucugucccaguuuuaaccguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcacccucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaaugggacggggcguagacguuaa

SEQ ID NO: 7932 - RNA, 1617 nt, Artificial Sequence
  VP1__Norovirus_and/or_Norovirus-like__LC101819
augaagauggcgucgaaugacgacaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucacugccgggaaggucauauuugcagcagucccaccaaauuuuccaacugaaggcuugagccccagccaggucacuauguucccccauauaguaguagauguuaggcaacuagaaccuguguugauucccuuacccgaugucaggaauaauuucuaucauuacaaccaaucaaaugaccccaccauuaaguugauagcaaugcuguauacaccacuuagggcuaauaaugcuggggaugaugucuucacaguuucuugccgaguucucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaaugguaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagagauacucauaaugugcaucuggcccccgcuguagcccccacuuuuccgggugagcaacuucucuucuucagauccaccaugcccggauguagcggguaccccaacauggauuuggacugucugcucccucaggaaugggugcaguacuucuaccaagaggcagccccagcacaaucugauguggcccugcuaagauuugugaauccagacacagguaggguuuuguucgaguguaagcuucauaaaucaggcuauguuacaguggcucacacuggccaacaugauuugguuaucccccccaaugguuauuuuagguuugauuccugggucaacaaguuuuacacgcuugcucccaugggaaauggaacggggcguagacguuaa

SEQ ID NO: 7933 - RNA, 1617 nt, Artificial Sequence
  VP1__Norovirus_and/or_Norovirus-like__KT202795
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaauuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaacuacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguggcaccacccaccgaaaugaaccccaacagugggugcucccaaguuacucaggcagaaauauuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7934 - RNA, 1617 nt, Artificial Sequence
  VP1__Norovirus_and/or_Norovirus-like__AB933742
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuggguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccuggaucaaccaguucuacacacuugcccccaugggaaaugggacggggcguagacguuaa

SEQ ID NO: 7935 - RNA, 1617 nt, Artificial Sequence
  VP1__Norovirus_and/or_Norovirus-like__AB933722
augaagauggcgucuagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccgggugaaauacuauggagcgcgcccuuaggcccugaucugaaucccuaccugucucauuuggccagaauguauaaugguuaugcaggugguuuugaagugcaggugauucucgcggggaacgcguucaccgccggaaaaauuauauuugcagcaguuccaccaaauuuuccaacugaaggcuugagucccagccaggucacuauguucccccauauaauaguggauguuaggcaauuggaaccuguguugauccccuuaccugauguuaggaauaacuucuaccacuauaaucagucaaaugacucuaccauuaaauugauagcaaugcuguauacaccacuuagggcuaauaaugcuggggaagauguuuuuacagucucuugucgaguucucacgaggccauccccugauuuugauuuuauauuuuuggugccaccuacaguugagucaagagcuaaaccauuuacugucccaaucuuaacuguugaagaaaugaccaauucaagauuccccauuccuuuggaaaaauuguucacgggccccagcagcgccuuuguuguucaaccacaaaauggcagaugcacgacugauggugugcucuuaggcaccacccaacugucuccugucaacaucugcaccuucagaggggaugucacccacauugcagguucucguaauuacacaaugaauuuggcuucuccaaauuggaacaauuaugacccaacagaagaaauuccagccccucuaggaacuccagauuuugugggaaagauccaggguaugcucacccaaaccacaaagggagaugguucgacccguggccauaaagccacaguuuacacugggagugcccccuuuacuccaaagcugggcaguguucaauucaguacugacacagaaaaugauuuugaaacucaccaaaacacaaaauucaccccagucggugucauccaggaugguagcaccacccaccgaaaugaaccccaacaaugggugcucccaaguuauucagguagaaaugucccuaauguacaccuagccccugcuguagcccccacuuucccgggugaacaacuucuuuucuuuaggucuacuaugcccggaugcagcggguaucccaacauggauuuggauugccuacucccucaggagugggugcagcacuucuaccaagaggcagcuccagcacaaucugauguggcucuauugagguuugugaacccagacacggguaggguccuauuugaguguaaacuucauaaaucagguuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7936 - RNA, 1617 nt, Artificial Sequence
  VP1__Norovirus_and/or_Norovirus-like__KJ678138
augaagauggcgucgagugacgccaacccaucugauggguccgcagccagccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacauugggagcgccgacuuugcuccaaaacuggguagaguucaauuugaaacugacacagaccaugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7937 - RNA, 1617 nt, Artificial Sequence
  VP1__Norovirus_and/or_Norovirus-like__KP244317
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguucacaguauccccuagaaacgcuccaggugaaauacuauggagcgcacccuuaggcccugauuugaauccuuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagucaggucacuauguucccccacauaauaguagauguuaggcaauuggaaccuguguugauucccuuacccgauguuaggaauaauuucuaccauuauaaucaaucaaaugaccccaccaucaaauugauagcaagguuguacacaccacuuagggcuaauaaugccggggacgaugucuucacaguuucuugucgaguccucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucuccugucaacaucugcaccuucagaggggaugucacccacauuucaggcagucguaacuacacaaugaauuuggcuucccaaaauuggaacaguuacgauccaacagaagaaaucccagccccucuaggaacuccagauuucguggggaagauucaaggugugcucacccaaaccacaaagacgaauggcucgacccgcggccacaaagcuacaguguacacugggagcgccgauuuuuccccaaaacuggguagaguucaauuugccacugacacagauaaugacuuugaaacuaaccaaaacacaaaguucaccccagucgguguuauccaggaugguaguacuaccccccgaaaugaaccccaacaaugggugcucccaaguuacucaggcagaaacacccauaauguacaccuggcccccgcuguagcccccacuuucccgggcgagcagcuccucuucuucagaucuacuaugcccggaugcagcggguaccccaacauggaucuggacugccugcucccccaggagugggugcaguauuucuaucaggaggcagccccagcacaaucugacguggcucuguuaagguuugugaauccagauacagguaggguuuuguuugaguguaagcuucauaaaucaggcuauguuacaguggcucauacuggccaacaugauuuggucaucccccccaaugguuauuuuagauuugauuccuggguuaaccaguuccacacacuugcccccaugggaaaugggacggggcguagacguuaa
